(12) United States Patent
Kudithipudi et al.

(10) Patent No.: US 11,293,030 B2
(45) Date of Patent: Apr. 5, 2022

(54) OPTIMIZED TISSUE-PREFERRED PROMOTER AND USES THEREOF

(71) Applicant: Altria Client Services LLC, Richmond, VA (US)

(72) Inventors: Chengalrayan Kudithipudi, Midlothian, VA (US); Jaemo Yang, Richmond, VA (US); Yanxin Shen, Glen Allen, VA (US); Dongmei Xu, Glen Allen, VA (US); Ujwala Warek, Chester, VA (US); James Strickland, Richmond, VA (US); Jesse Frederick, Richmond, VA (US)

(73) Assignee: Altria Client Services LLC, Richmond, VA (US)

( * ) Notice: Subject to any disclaimer, the term of this patent is extended or adjusted under 35 U.S.C. 154(b) by 0 days.

(21) Appl. No.: 16/529,365

(22) Filed: Aug. 1, 2019

(65) Prior Publication Data

US 2020/0040350 A1 Feb. 6, 2020

Related U.S. Application Data

(60) Provisional application No. 62/713,819, filed on Aug. 2, 2018.

(51) Int. Cl.
*C12N 15/82* (2006.01)

(52) U.S. Cl.
CPC ....... *C12N 15/8235* (2013.01); *C12N 15/827* (2013.01)

(58) Field of Classification Search
None
See application file for complete search history.

(56) References Cited

U.S. PATENT DOCUMENTS

| | | |
|---|---|---|
| 4,762,785 A | 8/1988 | Comai |
| 4,945,050 A | 7/1990 | Sanford et al. |
| 5,004,863 A | 4/1991 | Umbeck |
| 5,104,310 A | 4/1992 | Saltin |
| 5,141,131 A | 8/1992 | Miller, Jr. et al. |
| 5,149,645 A | 9/1992 | Hoekema et al. |
| 5,159,135 A | 10/1992 | Umbeck |
| 5,177,010 A | 1/1993 | Goldman et al. |
| 5,231,019 A | 7/1993 | Paszkowski et al. |
| 5,316,931 A | 5/1994 | Donson et al. |
| 5,463,174 A | 10/1995 | Maloney et al. |
| 5,464,763 A | 11/1995 | Schilperoort et al. |
| 5,469,976 A | 11/1995 | Burchell |
| 5,563,055 A | 10/1996 | Townsend et al. |
| 5,589,367 A | 12/1996 | Donson et al. |
| 5,866,785 A | 2/1999 | Donson et al. |
| 5,879,918 A | 3/1999 | Tomes et al. |
| 5,886,244 A | 3/1999 | Tomes et al. |
| 5,889,190 A | 3/1999 | Donson et al. |
| 5,889,191 A | 3/1999 | Turpen |
| 5,932,782 A | 8/1999 | Bidney |
| 5,981,840 A | 11/1999 | Zhao et al. |
| 10,435,700 B2 * | 10/2019 | Kudithipudi ....... C12N 15/8295 |
| 2006/0191548 A1 | 8/2006 | Strickland et al. |
| 2016/0281100 A1 * | 9/2016 | Kudithipudi ....... C12N 15/8295 |
| 2017/0260535 A1 | 9/2017 | Xu et al. |

FOREIGN PATENT DOCUMENTS

| | | |
|---|---|---|
| EP | 2 383 344 A1 | 11/2011 |
| WO | WO 2004/041006 A1 | 5/2004 |
| WO | WO 2005/108587 A1 | 11/2005 |
| WO | WO 2011/027315 A1 | 3/2011 |
| WO | WO 2016/057515 A2 | 4/2016 |
| WO | WO 2017/122014 A1 | 7/2017 |
| WO | WO 2017/156535 A1 | 9/2017 |

OTHER PUBLICATIONS

Benfey et al, Science 250: 959-966, 1990 (Year: 1990).*
Altschul et al., "Basic Local Alignment Search Tool," *Journal of Molecular Biology*, 215:403-410 (1990).
Bowman et al., "Revised North Carolina Grade Index for Flue-Cured Tobacco," *Tobacco Science*, 32:39-40 (1988).
Chenna et al., "Multiple sequence alignment with the Clustal series of programs," *Nucleic Acids Research* 31: 3497-3500 (2003).
Crone et al., "The Differential Expression of a Heat Shock Promoter in Floral and Reproductive Tissues," *Plant Cell Environ.*, 24:869-874 (2001).
Davis, D. L., and M. T. Nielsen. "World Agriculture Series: Tobacco Production." Chemistry and Technology. London: Blackwell Science (1999).
Fisher et al., "Topping, Managing Suckers, and Using Ethepon," *Flue-Cured Tobacco Information*, North Carolina State University, pp. 96-117 (2016).
Goldman et al., "Female Sterile Tobacco Plants Are Produced by Stigma," *EMBO Journal*, 13:2976-2984 (1994).
Horsch et al., "A Simple and General Method for Transferring Genes into Plants," *Science*, 227:1229-1231 (1985).
International Search Report and Written Opinion dated Nov. 29, 2019, in International Patent Application No. PCT/US2019/044615.
Larkin MA et al., "Clustal W and Clustal X version 2.0," *Bioinformatics* 23: 2947-48 (2007)
Mayo et al., "Genetic Transformation of Tobacco NT1 Cells with Agrobacterium tumefaciens," *Nature Protocols*, 1(3):1105-11 (2006)
Miller et al., "A Grade Index for Type 22 and 23 Fire-Cured Tobacco," *Tobacco International*, 192:55-57 (1990).
Miller, "Memorandum on the Proposed Burley Tobacco Grade Index," Legacy Tobacco Document Library, Bates Nos. 523267826-523267833 (1988).
Official Standard Grades for Burley Tobacco (U.S. Type 31 and Foreign Type 93), effective Nov. 5, 1990 (55 F.R. 40645).

(Continued)

*Primary Examiner* — Elizabeth F McElwain
(74) *Attorney, Agent, or Firm* — Arnold & Porter Kaye Scholer LLP

(57) ABSTRACT

The present disclosure provides the identification of promoters that are preferentially active in tobacco axillary buds. Also provided are tobacco plants comprising reduced or no sucker growth. Also provided are methods and compositions for producing tobacco plants comprising reduced or no sucker growth.

17 Claims, 10 Drawing Sheets

Specification includes a Sequence Listing.

(56) References Cited

OTHER PUBLICATIONS

Official Standard Grades for Flue-Cured Tobacco (U.S. Types 11, 12, 13, 14 and Foreign Type 92), effective Mar. 27, 1989 (54 F.R. 7925).
Official Standard Grades for Georgia and Florida Shade-Grown Cigar-Wrapper Tobacco (U.S. Type 62), Effective Apr. 1971 (36 F.R. 5669).
Official Standard Grades for Ohio Cigar-Leaf Tobacco (U.S. Types 42, 43, and 44), effective Dec. 8, 1963 (28 F.R. 11719 and 28 F.R. 11926).
Official Standard Grades for Pennsylvania Seedleaf Tobacco (U.S. Type 41), effective Jan. 8, 1965 (29 F.R. 16854).
Official Standard Grades for Wisconsin Cigar-Binder Tobacco (U.S. Types 54 and 55), effective Nov. 20, 1969 (34 F.R. 17061).
Thompson et al., "Clustal W: Improving the sensitivity of progressive multiple sequence alignment through sequence weighting, position-specific gap penalties and weight matrix choice," *Nucleic Acids Research* 22: 4673-4680 (1994).
Wernsman, E. A., and Rufty, R. C., "Tobacco," Chapter 17, pp. 669-698. In: Cultivar Development. Crop Species. W. H. Fehr (ed.), MacMillan Publishing Co., Inc., New York, N.Y. (1987).

\* cited by examiner

Cis-elements

▨ Bud Dormancy Element (CACGTG/SEQ ID NO: 258)

○ Sugar Repressive Element (TTATCC/SEQ ID NO: 259)

△ Axillary Bud Up2 Element (AAACCCTA/SEQ ID NO: 260)

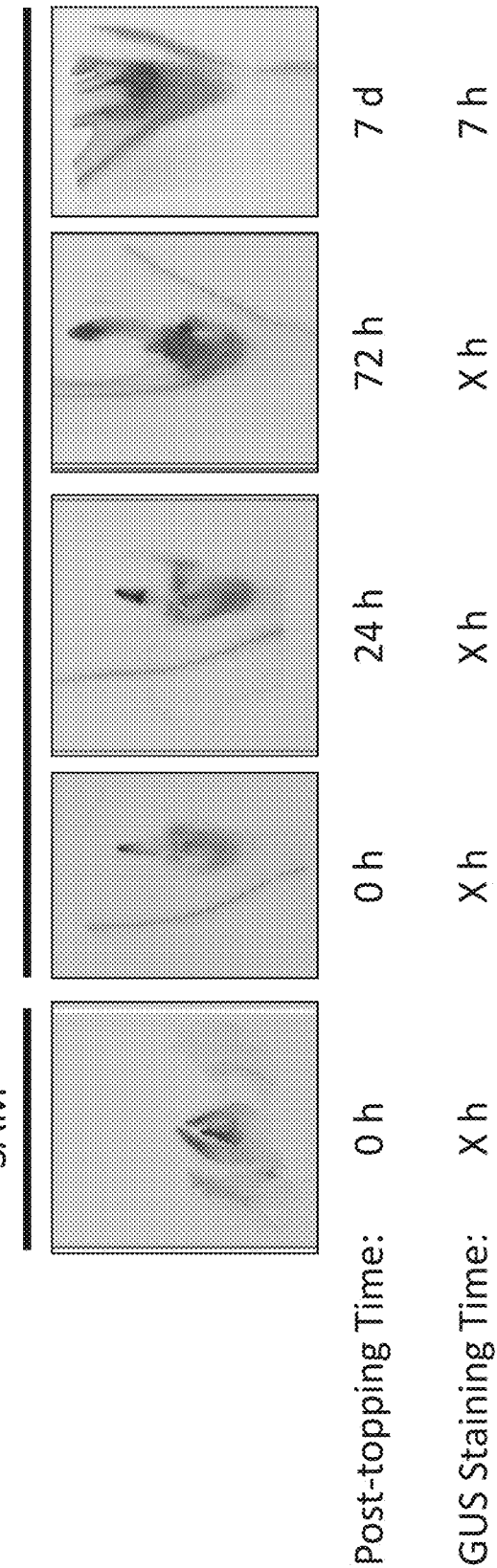

Panel 4B

SEQ ID NO: 113::GUS

SEQ ID NO: 257::GUS

Stigma

Anther/Pollen Grains

Panel 8A

Wild Type

SEQ ID NO: 257::Barnase

Panel 8B

Wild Type

SEQ ID NO: 257::Barnase

OPTIMIZED TISSUE-PREFERRED PROMOTER AND USES THEREOF

CROSS-REFERENCE TO RELATED APPLICATIONS

This application claims the benefit under 35 U.S.C. § 119 of U.S. Provisional Application No. 62/713,819, filed Aug. 2, 2018, which is herein incorporated by reference in its entirety.

FIELD

The present disclosure provides methods and compositions for refining the expression of nucleic acids and proteins useful for the reduction or elimination of suckers in plants.

INCORPORATION OF SEQUENCE LISTING

A sequence listing contained in the file named "P34633US01_SL.TXT" which is 733,397 bytes (measured in MS-Windows®) and created on Aug. 1, 2019 is filed electronically herewith and incorporated by reference in its entirety.

BACKGROUND

Tobacco is a plant species that exhibits exceptionally strong apical dominance. Molecular signals from the shoot apical meristem (SAM) mediate a hormonal signal that effectively inhibits axillary bud growth. Upon removal of the SAM (also known as "topping"), physiological and molecular changes occur, enabling the growth of new shoots (or "suckers") from axillary meristems (buds). Sucker growth results in loss of yield and leaf quality. Suckers have been controlled by manual removal and through the application of chemicals. Maleic hydrazide and flumetralin are routinely used on topped plants to inhibit axillary bud growth ("suckering"). However, labor and chemical agents to control suckers are very expensive. Control of suckering in tobacco through conventional breeding, mutation breeding, and transgenic approaches have been a major objective for several decades but, to date, successful inhibition or elimination of suckering has not been achieved through these approaches. Recent molecular work has produced transgenic plants with reduced or eliminated suckers, but leaky expression of axillary bud-degrading genes can result in the death of seeds and embryos and prevents the production of successive generations of transgenic plants. Therefore, development of methods and compositions to prevent axillary bud-degrading genes from being expressed in non-desired tissues and/or organs would result in a reduction of the use of chemical agents and would reduce costs and labor associated with tobacco production.

SUMMARY

In one aspect, this disclosure provides a nucleic acid molecule comprising a promoter active in axillary bud tissue, where the promoter: (a) comprises a sequence having at least 75% identity to SEQ ID NO: 113, where the identity is based on, and limited to, the entire alignable region or regions between said sequence and SEQ ID NO: 113; (b) comprises a deletion of at least 50 contiguous nucleotides as compared to SEQ ID NO: 113; and (c) is operably linked to a heterologous nucleic acid molecule.

In one aspect, this disclosure provides a tobacco plant comprising a nucleic acid molecule comprising a promoter active in axillary bud tissue, where the promoter: (a) comprises a sequence having at least 75% identity to SEQ ID NO: 113, where the identity is based on, and limited to, the entire alignable region or regions between said sequence and SEQ ID NO: 113; (b) comprises a deletion of at least 50 contiguous nucleotides as compared to SEQ ID NO: 113; and (c) is operably linked to a heterologous nucleic acid molecule, where the tobacco plant comprises no suckers or reduced suckers after topping as compared to a control tobacco plant of the same variety when grown under comparable conditions.

In one aspect, this disclosure provides a plant or seed comprising a nucleic acid molecule, where the nucleic acid molecule comprises a promoter active in axillary bud tissue, where the promoter: (a) comprises a sequence having at least 75% identity to SEQ ID NO: 113, where the identity is based on, and limited to, the entire alignable region or regions between said sequence and SEQ ID NO: 113; (b) comprises a deletion of at least 50 contiguous nucleotides as compared to SEQ ID NO: 113; and (c) is operably linked to a heterologous nucleic acid molecule encoding an axillary bud-degrading product.

In one aspect, this disclosure provides a method for controlling topping-induced suckers in a tobacco plant comprising: (a) introducing a nucleic acid molecule to a tobacco cell, wherein said nucleic acid molecule comprises a promoter active in axillary bud tissue, where the promoter: (i) comprises a sequence having at least 75% identity to SEQ ID NO: 113, where the identity is based on, and limited to, the entire alignable region or regions between said sequence and SEQ ID NO: 113; (ii) comprises a deletion of at least 50 contiguous nucleotides as compared to SEQ ID NO: 113; and (iii) is operably linked to a heterologous nucleic acid molecule encoding an axillary bud-degrading product; and (b) regenerating a tobacco plant from said tobacco cell, where the tobacco plant comprises no or reduced topping-induced suckers as compared to a control tobacco plant grown under comparable conditions.

In one aspect, this disclosure provides a method of growing a tobacco plant comprising planting a tobacco seed comprising a nucleic acid molecule, where the nucleic acid molecule comprises a promoter active in axillary bud tissue, where the promoter: (a) comprises a sequence having at least 75% identity to SEQ ID NO: 113, wherein said identity is based on, and limited to, the entire alignable region or regions between said sequence and SEQ ID NO: 113; (b) comprises a deletion of at least 50 contiguous nucleotides as compared to SEQ ID NO: 113; and (c) is operably linked to a heterologous nucleic acid molecule encoding an axillary bud-degrading product, where the tobacco seed germinates into a tobacco plant comprising no or reduced topping-induced suckers as compared to a control tobacco plant grown under comparable conditions.

BRIEF DESCRIPTION OF THE SEQUENCES

SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and 257-260 are nucleic acid sequences.

SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255, and 256 are polypeptide sequences.

Additional descriptions of the SEQ ID NOs provided herein can be found in Table 1.

TABLE 1

Description of sequences

| SEQ ID NO | Sequence Type | Sequence Description | NCBI Accession Number of the Top Hit of A BLAST Search |
|---|---|---|---|
| 1 | Nucleic Acid | Transcription factor CYCLOIDEA-like | XM_009609861.1 |
| 2 | Peptide | Transcription factor CYCLOIDEA-like | |
| 3 | Nucleic Acid | Flower-specific gamma-thionin | P32026.1 |
| 4 | Peptide | Flower-specific gamma-thionin | |
| 5 | Nucleic Acid | Polyphenoloxidase | XP_006347083.1 |
| 6 | Peptide | Polyphenoloxidase | |
| 7 | Nucleic Acid | UDP-glucose:glucosyltransferase | BAG80546.1 |
| 8 | Peptide | UDP-glucose:glucosyltransferase | |
| 9 | Nucleic Acid | Tumor-related protein | BAA05479.1 |
| 10 | Peptide | Tumor-related protein | |
| 11 | Nucleic Acid | Hypothetical protein | CAN66732.1 |
| 12 | Peptide | Hypothetical protein | |
| 13 | Nucleic Acid | TCP1 protein-like gene | FJ194953.1 |
| 14 | Peptide | TCP1 protein-like gene | |
| 15 | Nucleic Acid | Chlorophyllase-2 | EYU43828.1 |
| 16 | Peptide | Chlorophyllase-2 | |
| 17 | Nucleic Acid | AP2/ERF domain-containing transcription factor | XP_006363442.1 |
| 18 | Peptide | AP2/ERF domain-containing transcription factor | |
| 19 | Nucleic Acid | Putative miraculin | XP_006360306.1 |
| 20 | Peptide | Putative miraculin | |
| 21 | Nucleic Acid | Oleosin | XP_004236249.1 |
| 22 | Peptide | Oleosin | |
| 23 | Nucleic Acid | ACC synthase | XP_006356827.1 |
| 24 | Peptide | ACC synthase | |
| 25 | Nucleic Acid | LOB domain-containing protein 18-like | XP_007052037.1 |
| 26 | Peptide | LOB domain-containing protein 18-like | |
| 27 | Nucleic Acid | Vicilin-like antimicrobial peptides cupin super family | XP_006363154.1 |
| 28 | Peptide | Vicilin-like antimicrobial peptides cupin super family | |
| 29 | Nucleic Acid | Abscisic acid insensitive | XP_006341248.1 |
| 30 | Peptide | Abscisic acid insensitive | |
| 31 | Nucleic Acid | Seipin-like | XP_004237589.1 |
| 32 | Peptide | Seipin-like | |
| 33 | Nucleic Acid | Transcription factor CYCLOIDEA-like | XM_009618194.1 |
| 34 | Peptide | Transcription factor CYCLOIDEA-like | |
| 35 | Nucleic Acid | Transcription factor DICHOTOMA-like | XM_009593876.1 |
| 36 | Peptide | Transcription factor DICHOTOMA-like | |
| 37 | Nucleic Acid | Transcription factor CYCLOIDEA-like | XM_009764845.1 |
| 38 | Peptide | Transcription factor CYCLOIDEA-like | |
| 39 | Nucleic Acid | RING-H2 finger protein ATL11-like | XP_004251547.1 |
| 40 | Peptide | RING-H2 finger protein ATL11-like | |
| 41 | Nucleic Acid | Homeobox-leucine zipper protein ATHB-40-like | XP_004232382.1 |
| 42 | Peptide | Homeobox-leucine zipper protein ATHB-40-like | |
| 43 | Nucleic Acid | Uncharacterized protein-LOC102586855 isoform X1 | XP_006357617.1 |
| 44 | Peptide | Uncharacterized protein-LOC102586855 isoform X1 | |
| 45 | Nucleic Acid | Unknown | CAN63006.1 |
| 46 | Peptide | Unknown | |
| 47 | Nucleic Acid | MADS affecting flowering 5-like isoform X1/X2 | XP_006366525.1 |

TABLE 1-continued

Description of sequences

| SEQ ID NO | Sequence Type | Sequence Description | NCBI Accession Number of the Top Hit of A BLAST Search |
|---|---|---|---|
| 48 | Peptide | MADS affecting flowering 5-like isoform X1/X2 | |
| 49 | Nucleic Acid | Nuclear transcription factor Y subunit | XP_006351227.1 |
| 50 | Peptide | Nuclear transcription factor Y subunit | |
| 51 | Nucleic Acid | Nuclear transcription factor Y subunit A-7-like | XP_006351229.1 |
| 52 | Peptide | Nuclear transcription factor Y subunit A-7-like | |
| 53 | Nucleic Acid | Transcription factor CYCLOIDEA-like | XM_009767637.1 |
| 54 | Peptide | Transcription factor CYCLOIDEA-like | |
| 55 | Nucleic Acid | *Arabidopsis* cytokinin oxidase | NM_129714.3 |
| 56 | Peptide | *Arabidopsis* cytokinin oxidase | |
| 57 | Nucleic Acid | *Nicotiana tabacum* cytokinin oxidase | XM_009611148.1 |
| 58 | Peptide | *Nicotiana tabacum* cytokinin oxidase | |
| 59 | Nucleic Acid | *Nicotiana tabacum* cytokinin oxidase | XM_009632505.1 |
| 60 | Peptide | *Nicotiana tabacum* cytokinin oxidase | |
| 61 | Nucleic Acid | *Nicotiana tabacum* Isopentenyl transferase gene (IPT-g120126) | XM_009784416.1 |
| 62 | Peptide | *Nicotiana tabacum* Isopentenyl transferase gene (IPT-g120126) | |
| 63 | Nucleic Acid | *Nicotiana tabacum* WUSCHEL (WUS-g151887) | XM_009589135.1 |
| 64 | Peptide | *Nicotiana tabacum* WUSCHEL (WUS-g151887) | |
| 65 | Nucleic Acid | *Nicotiana tabacum* WUSCHEL (WUS-g135280) | XM_009793912.1 |
| 66 | Peptide | *Nicotiana tabacum* WUSCHEL (WUS-g135280) | |
| 67 | Nucleic Acid | *Arabidopsis thaliana* CLAVATA3 (CLV3) | NM_001124926.1 |
| 68 | Peptide | *Arabidopsis thaliana* CLAVATA3 (CLV3) | |
| 69 | Nucleic Acid | *Nicotiana tabacum* CLAVATA3 (Scaffold00010610) | XM_009628563.1 |
| 70 | Peptide | *Nicotiana tabacum* CLAVATA3 (Scaffold00010610) | |
| 71 | Nucleic Acid | *Nicotiana tabacum* LATERAL SUPPRESSOR (g56830) | XM_009619761.1 |
| 72 | Peptide | *Nicotiana tabacum* LATERAL SUPPRESSOR (g56830) | |
| 73 | Nucleic Acid | *Nicotiana tabacum* LATERAL SUPPRESSOR (scafflod0004261) | XM_009766770.1 |
| 74 | Peptide | *Nicotiana tabacum* LATERAL SUPPRESSOR (scafflod0004261) | |
| 75 | Nucleic Acid | *Nicotiana tabacum* REGULATOR OF AXILLARY MERISTEMS (RAX-scaffold0000950) | XM_009802273.1 |
| 76 | Peptide | *Nicotiana tabacum* REGULATOR OF AXILLARY MERISTEMS (RAX-scaffold0000950) | |
| 77 | Nucleic Acid | *Nicotiana tabacum* REGULATOR OF AXILLARY MERISTEMS (RAX-scaffold00001904) | XM_009602411.1 |
| 78 | Peptide | *Nicotiana tabacum* REGULATOR OF AXILLARY MERISTEMS (RAX-scaffold00001904) | |
| 79 | Nucleic Acid | *Bacillus amyloliquefaciens* extracellular ribonuclease (Barnase) | CP009748.1 |
| 80 | Peptide | *Bacillus amyloliquefaciens* extracellular ribonuclease (Barnase) | |
| 81 | Nucleic Acid | *Arabidopsis thaliana* BRANCHED1 | NM_001125184.1 |
| 82 | Peptide | *Arabidopsis thaliana* BRANCHED1 | |
| 83 | Nucleic Acid | RNAi_1 (targeting SEQ ID NO: 1) | |
| 84 | Nucleic Acid | RNAi_2 (targeting SEQ ID NO: 3) | |
| 85 | Nucleic Acid | RNAi_5 (targeting SEQ ID NO: 9) | |

TABLE 1-continued

Description of sequences

| SEQ ID NO | Sequence Type | Sequence Description | NCBI Accession Number of the Top Hit of A BLAST Search |
|---|---|---|---|
| 86 | Nucleic Acid | RNAi_7 (targeting SEQ ID NO: 13) | |
| 87 | Nucleic Acid | RNAi_8 (targeting SEQ ID NO: 15) | |
| 88 | Nucleic Acid | RNAi_9 (targeting SEQ ID NO: 17) | |
| 89 | Nucleic Acid | RNAi_10 (targeting SEQ ID NO: 19) | |
| 90 | Nucleic Acid | RNAi_12 (targeting SEQ ID NO: 21) | |
| 91 | Nucleic Acid | RNAi_14 (targeting SEQ ID NO: 25) | |
| 92 | Nucleic Acid | RNAi_15 (targeting SEQ ID NO: 27) | |
| 93 | Nucleic Acid | RNAi_16 (targeting SEQ ID NO: 29) | |
| 94 | Nucleic Acid | RNAi_17 (targeting SEQ ID NO: 31) | |
| 95 | Nucleic Acid | RNAi_18 (targeting SEQ ID NO: 35) | |
| 96 | Nucleic Acid | RNAi_26 (targeting SEQ ID NO: 49) | |
| 97 | Nucleic Acid | RNAi_61 (targeting SEQ ID NO: 61) | |
| 98 | Nucleic Acid | RNAi_63 and 65 (targeting SEQ ID NO: 63 and 65) | |
| 99 | Nucleic Acid | RNAi_71 and 73 (targeting SEQ ID NO: 71 and 73) | |
| 100 | Nucleic Acid | RNAi_75 and 77 (targeting SEQ ID NO: 75 and 77) | |
| 101 | Nucleic Acid | RNAi_CET-26-6 (targeting SEQ ID NO: 11, 49, 108, 109 and 110) | |
| 102 | Nucleic Acid | RNAi_45-2-7-TDNA-145337-RI (targeting SEQ ID NO: 39) | |
| 103 | Nucleic Acid | RNAi_45-2-7-TDNA-348CDS-RI (targeting SEQ ID NO:41) | |
| 104 | Nucleic Acid | RNAi_45-2-7-TDNA-131180CDS-RI (targeting SEQ ID NO: 43) | |
| 105 | Nucleic Acid | RNAi_45-2-7-TDNA-22266-RI (targeting SEQ ID NO: 45) | |
| 106 | Nucleic Acid | RNAi_45-2-7-TDNA-53803/75660-RI (targeting SEQ ID NO: 49) | |
| 107 | Nucleic Acid | RNAi_45-2-7-TDNA-21860-RI (targeting SEQ ID NO: 47) | |
| 108 | Nucleic Acid | CEN-like protein 2 (CET2) g114109 | AF145260.1 |
| 109 | Nucleic Acid | CEN-like protein 2 (CET2) g2420 | XM_009596199.1 |
| 110 | Nucleic Acid | CEN-like protein 2 (CET2) Scaffold0003597 CDS | XM_009787775.1 |
| 111 | Nucleic Acid | Transformation cassette | |
| 112 | Nucleic Acid | *Agrobacterium* transformation vector p45-2-7 | |
| 113 | Nucleic Acid | A promoter sequence of a gene encoding SEQ ID NO: 2 (Gene 1) | |
| 114 | Nucleic Acid | A promoter sequence of a gene encoding SEQ ID NO: 8 (Gene 4) | |
| 115 | Nucleic Acid | A promoter sequence of a gene encoding SEQ ID NO: 14 (Gene 7) | |
| 116 | Nucleic Acid | promoter of SEQ ID NO: 275 (Gene 11) | |
| 117 | Nucleic Acid | A promoter sequence of a gene encoding SEQ ID NO: 28 (Gene 15) | |
| 118 | Nucleic Acid | A promoter sequence of a gene encoding SEQ ID NO: 4 (Gene 2) | |
| 119 | Nucleic Acid | Sequence for TALEN donor, which targets a gene encoding SEQ ID NO: 1 | |
| 120 | Nucleic Acid | Sequence for TALEN binding sites, which targets a gene encoding SEQ ID NO: 1 | |
| 121 | Nucleic Acid | Sequence for TALEN, include promoter NO: 118, NO: 113 which targets a gene encoding SEQ ID NO: 13 | |

TABLE 1-continued

Description of sequences

| SEQ ID NO | Sequence Type | Sequence Description | NCBI Accession Number of the Top Hit of A BLAST Search |
|---|---|---|---|
| 122 | Nucleic Acid | Sequence for TALEN biding sites, which targets a gene encoding SEQ ID NO: 13 | |
| 123 | Nucleic Acid | *Nicotiana tabacum* T2 Rnase | XP_009794914.1 |
| 124 | Nucleic Acid | *Nicotiana tabacum* T2 Rnase | XP_009766067.1 |
| 125 | Nucleic Acid | *Nicotiana tabacum* P1 Rnase | XP_009597823.1 |
| 126 | Nucleic Acid | *Nicotiana tabacum* Rnase | XP_009775662.1 |
| 127 | Nucleic Acid | *Nicotiana tabacum* T2 Rnase | XM_009794797.1 |
| 128 | Nucleic Acid | *Nicotiana tabacum* T2 Rnase | XM_009627900.1 |
| 129 | Nucleic Acid | *Nicotiana tabacum* T2 Rnase | JQ041907.1 |
| 130 | Nucleic Acid | *Nicotiana tabacum* T2 Rnase | XM_009795594.1 |
| 131 | Nucleic Acid | *Nicotiana tabacum* T2 Rnase | XM_009795502.1 |
| 132 | Nucleic Acid | *Nicotiana tabacum* T2 Rnase | XM_009606804.1 |
| 133 | Nucleic Acid | *Nicotiana tabacum* T2 Rnase | XM_009794798.1 |
| 134 | Nucleic Acid | *Nicotiana tabacum* T2 Rnase | AB034638.1 |
| 135 | Nucleic Acid | *Nicotiana tabacum* T2 Rnase | XM_009784762.1 |
| 136 | Nucleic Acid | *Nicotiana tabacum* T2 Rnase | XM_009798107.1 |
| 137 | Nucleic Acid | VPE14 | XM_009773 063.1 |
| 138 | Nucleic Acid | VPE15 | XM_009594104.1 |
| 139 | Nucleic Acid | VPE16 | XM_009784979.1 |
| 140 | Nucleic Acid | VPE17 | XM_009765910.1 |
| 141 | Nucleic Acid | VPE4 | XM_009623321.1 |
| 142 | Nucleic Acid | VPE6 | XM_009764257.1 |
| 143 | Nucleic Acid | VPE7 | AB075949.1 |
| 144 | Nucleic Acid | *Nicotiana tabacum* Proteinase | XM_009801188.1 |
| 145 | Nucleic Acid | *Nicotiana tabacum* Proteinase | XM_009792063.1 |
| 146 | Nucleic Acid | *Nicotiana tabacum* Proteinase | XM_009779330.1 |
| 147 | Nucleic Acid | *Nicotiana tabacum* Proteinase | XM_009764284.1 |
| 148 | Nucleic Acid | Thionin 5' upstream regulatory sequence | |
| 149 | Nucleic Acid | *Nicotiana tabacum* Lateral Suppressor1 (LAS1) 5' upstream regulatory sequence | |
| 150 | Nucleic Acid | *Nicotiana tabacum* LAS1 3' downstream regulatory sequence | |
| 151 | Nucleic Acid | *Nicotiana tabacum* LAS2 5' upstream regulatory sequence | |
| 152 | Nucleic Acid | *Nicotiana tabacum* LAS2 3' downstream regulatory sequence | |
| 153 | Nucleic Acid | *Nicotiana tabacum* Regulator of Axillary Meristems1 (RAX1) 5' upstream regulatory sequence | |
| 154 | Nucleic Acid | *Nicotiana tabacum* RAX1 3' downstream regulatory sequence | |
| 155 | Nucleic Acid | *Nicotiana tabacum* RAX2 5' upstream regulatory sequence | |
| 156 | Nucleic Acid | *Nicotiana tabacum* RAX2 3' downstream regulatory sequence | |
| 157 | Nucleic Acid | SEQ ID NO: 27 5' upstream regulatory sequence | |

TABLE 1-continued

Description of sequences

| SEQ ID NO | Sequence Type | Sequence Description | NCBI Accession Number of the Top Hit of A BLAST Search |
|---|---|---|---|
| 158 | Nucleic Acid | SEQ ID NO: 27 3' downstream regulatory sequence | |
| 159 | Nucleic Acid | SEQ ID NO: 27 homolog 5' upstream regulatory sequence | |
| 160 | Nucleic Acid | SEQ ID NO: 27 homolog 3' downstream regulatory sequence | |
| 161 | Peptide | *Nicotiana tabacum* T2 Rnase encoded by SEQ ID NO: 123 | |
| 162 | Peptide | *Nicotiana tabacum* T2 Rnase encoded by SEQ ID NO: 124 | |
| 163 | Peptide | *Nicotiana tabacum* P1 Rnase encoded by SEQ ID NO: 125 | |
| 164 | Peptide | *Nicotiana tabacum* Rnase encoded by SEQ ID NO: 126 | |
| 165 | Peptide | *Nicotiana tabacum* T2 Rnase encoded by SEQ ID NO: 127 | |
| 166 | Peptide | *Nicotiana tabacum* T2 Rnase encoded by SEQ ID NO: 128 | |
| 167 | Peptide | *Nicotiana tabacum* T2 Rnase encoded by SEQ ID NO: 129 | |
| 168 | Peptide | *Nicotiana tabacum* T2 Rnase encoded by SEQ ID NO: 130 | |
| 169 | Peptide | *Nicotiana tabacum* T2 Rnase encoded by SEQ ID NO: 131 | |
| 170 | Peptide | *Nicotiana tabacum* T2 Rnase encoded by SEQ ID NO: 132 | |
| 171 | Peptide | *Nicotiana tabacum* T2 Rnase encoded by SEQ ID NO: 133 | |
| 172 | Peptide | *Nicotiana tabacum* T2 Rnase encoded by SEQ ID NO: 134 | |
| 173 | Peptide | *Nicotiana tabacum* T2 Rnase encoded by SEQ ID NO: 135 | |
| 174 | Peptide | *Nicotiana tabacum* T2 Rnase encoded by SEQ ID NO: 136 | |
| 175 | Peptide | VPE14 encoded by SEQ ID NO: 137 | |
| 176 | Peptide | VPE15 encoded by SEQ ID NO: 138 | |
| 177 | Peptide | VPE16 encoded by SEQ ID NO: 139 | |
| 178 | Peptide | VPE17 encoded by SEQ ID NO: 140 | |
| 179 | Peptide | VPE4 encoded by SEQ ID NO: 141 | |
| 180 | Peptide | VPE6 encoded by SEQ ID NO: 142 | |
| 181 | Peptide | VPE7 encoded by SEQ ID NO: 143 | |
| 182 | Peptide | *Nicotiana tabacum* Proteinase encoded by SEQ ID NO: 144 | |
| 183 | Peptide | *Nicotiana tabacum* Proteinase encoded by SEQ ID NO: 145 | |
| 184 | Peptide | *Nicotiana tabacum* Proteinase encoded by SEQ ID NO: 146 | |
| 185 | Peptide | *Nicotiana tabacum* Proteinase encoded by SEQ ID NO: 147 | |
| 186 | Nucleic Acid | C12866 (Gene 11) | XP_006467846.1 |
| 187 | Peptide | C12866 (Gene 11) | |
| 188 | Nucleic Acid | *Nicotiana tabacum* STM homolog (NTH15) | AB004785 |
| 189 | Peptide | *Nicotiana tabacum* STM homolog (NTH15) | |
| 190 | Nucleic Acid | *Nicotiana tabacum* (Grassy Tillers1) GT1 homolog | |
| 191 | Peptide | *Nicotiana tabacum* (Grassy Tillers1) GT1 homolog | |
| 192 | Nucleic Acid | *Arabidopsis thaliana* More Axillary Branching1 (MAX2) | AK316903.1 |
| 193 | Peptide | *Arabidopsis thaliana* More Axillary Branching1 (MAX2) | |
| 194 | Nucleic Acid | *Arabidopsis thaliana* MAX2 | AAK97303.1 |
| 195 | Peptide | *Arabidopsis thaliana* MAX2 | |
| 196 | Nucleic Acid | *Nicotiana tabacum* MAX2 homolog | XM_009801023.1 |
| 197 | Peptide | *Nicotiana tabacum* MAX2 homolog | |
| 198 | Nucleic Acid | *Nicotiana tabacum* MAX2 homolog | XM_009625596.1 |
| 199 | Peptide | *Nicotiana tabacum* MAX2 homolog | |
| 200 | Nucleic Acid | *Arabidopsis thaliana* Lateral Suppressor (LAS) | BT026519.1 |

TABLE 1-continued

Description of sequences

| SEQ ID NO | Sequence Type | Sequence Description | NCBI Accession Number of the Top Hit of A BLAST Search |
|---|---|---|---|
| 201 | Peptide | *Arabidopsis thaliana* Lateral Suppressor (LAS) | |
| 202 | Nucleic Acid | *Arabidopsis thaliana* Regulator of Axillary Meristems (RAX) | AY519628.1 |
| 203 | Peptide | *Arabidopsis thaliana* Regulator of Axillary Meristems (RAX) | |
| 204 | Nucleic Acid | Regulatory region of *Solanum lycopersicum* homolog of SEQ ID NO: 28 | |
| 205 | Nucleic Acid | *Solanum lycopersicum* homolog of SEQ ID NO: 28 | HG975514.1 |
| 206 | Peptide | *Solanum lycopersicum* homolog of SEQ ID NO: 28 | |
| 207 | Nucleic Acid | *Arabidopsis thaliana* ALCATRAZ | |
| 208 | Peptide | *Arabidopsis thaliana* ALCATRAZ | |
| 209 | Nucleic Acid | *Arabidopsis thaliana* VND6 | |
| 210 | Peptide | *Arabidopsis thaliana* VND6 | |
| 211 | Nucleic Acid | *Arabidopsis thaliana* VND7 | |
| 212 | Peptide | *Arabidopsis thaliana* VND7 | |
| 213 | Nucleic Acid | *Solanum lycopersicum* Adi3 | |
| 214 | Peptide | *Solanum lycopersicum* Adi3 | |
| 215 | Nucleic Acid | *Arabidopsis thaliana* XCP1 | |
| 216 | Peptide | *Arabidopsis thaliana* XCP1 | |
| 217 | Nucleic Acid | *Arabidopsis thaliana* XCP2 | |
| 218 | Peptide | *Arabidopsis thaliana* XCP2 | |
| 219 | Nucleic Acid | *Arabidopsis thaliana* Metacaspase 2d (ATMC4) | |
| 220 | Peptide | *Arabidopsis thaliana* Metacaspase 2d (ATMC4) | |
| 221 | Nucleic Acid | *Arabidopsis thaliana* disease resistance protein RPS5 | |
| 222 | Peptide | *Arabidopsis thaliana* disease resistance protein RPS5 | |
| 223 | Nucleic Acid | *Nicotiana tabacum* TMV resistance N gene | |
| 224 | Peptide | *Nicotiana tabacum* TMV resistance N gene | |
| 225 | Nucleic Acid | *Saccharum* spp. mature miRNA159 | |
| 226 | Nucleic Acid | *Nicotiana tabacum* precursor miRNA159 | |
| 227 | Nucleic Acid | *Nicotiana tabacum* mature miRNA159 | |
| 228 | Nucleic Acid | *Nicotiana* NAC089 | |
| 229 | Peptide | *Nicotiana* NAC089 | |
| 230 | Nucleic Acid | *Nicotiana* BAG6 | |
| 231 | Peptide | *Nicotiana* BAG6 | |
| 232 | Nucleic Acid | *Nicotiana* mitogen-activated protein kinase kinase 2 (NtMEK2) | |
| 233 | Peptide | *Nicotiana* mitogen-activated protein kinase kinase 2 (NtMEK2) | |
| 234 | Nucleic Acid | *Arabidopsis thaliana* Flavin monooxygenase (YUCCA1) | |
| 235 | Peptide | *Arabidopsis thaliana* Flavin monooxygenase (YUCCA1) | |
| 236 | Nucleic Acid | *Arabidopsis thaliana* Pin-formed1 (PIN1) | |
| 237 | Peptide | *Arabidopsis thaliana* Pin-formed1 (PIN1) | |
| 238 | Nucleic Acid | *Arabidopsis thaliana* Tryptophan aminotransferase1/Transport inhibitor response2 (TAA1/TIR2) | |
| 239 | Peptide | *Arabidopsis thaliana* Tryptophan aminotransferase1/Transport inhibitor response2 (TAA1/TIR2) | |
| 240 | Nucleic Acid | *Arabidopsis thaliana* Aldehyde oxidase1 (AAO1) | |

TABLE 1-continued

Description of sequences

| SEQ ID NO | Sequence Type | Sequence Description | NCBI Accession Number of the Top Hit of A BLAST Search |
|---|---|---|---|
| 241 | Peptide | *Arabidopsis thaliana* Aldehyde oxidase1 (AAO1) | |
| 242 | Nucleic Acid | *Arabidopsis thaliana* Indole-3-acetamide hydrolase1 (AMI1) | |
| 243 | Peptide | *Arabidopsis thaliana* Indole-3-acetamide hydrolase1 (AMI1) | |
| 244 | Nucleic Acid | *Nicotiana* Flavin monooxygenase (NtYUCCA-like1) | |
| 245 | Peptide | *Nicotiana* Flavin monooxygenase (NtYUCCA-like1) | |
| 246 | Nucleic Acid | *Nicotiana* Flavin monooxygenase (NtYUCCA-like2) | |
| 247 | Peptide | *Nicotiana* Flavin monooxygenase (NtYUCCA-like2) | |
| 248 | Nucleic Acid | *Nicotiana* Pin-formed1-like (NtPIN1-like) | |
| 249 | Peptide | *Nicotiana* Pin-formed1-like (NtPIN1-like) | |
| 250 | Nucleic Acid | *Nicotiana* Tryptophan aminotransferase1/Transport inhibitor response2-like (NtTAA1/TIR2-like) | |
| 251 | Peptide | *Nicotiana* Tryptophan aminotransferase1/Transport inhibitor response2-like (NtTAA1/TIR2-like) | |
| 252 | Nucleic Acid | *Nicotiana* Aldehyde oxidase1-like (NtAAO1-like) | |
| 253 | Peptide | *Nicotiana* Aldehyde oxidase1-like (NtAAO1-like) | |
| 254 | Nucleic Acid | *Nicotiana* Indole-3-acetamide hydrolase1-like (NtAMI1-like) | |
| 255 | Peptide | *Nicotiana* Indole-3-acetamide hydrolase1-like (NtAMI1-like) | |
| 256 | Peptide | 6x Histidine tag | |
| 257 | Nucleic Acid | Promoter SEQ ID NO: 113 comprising a 100 nucleotide deletion | |
| 258 | Nucleic Acid | Bud Dormancy Element | |
| 259 | Nucleic Acid | Sugar Repressive Element | |
| 260 | Nucleic Acid | Axillary Bud up2 Element | |

DETAILED DESCRIPTION

Figure 1:
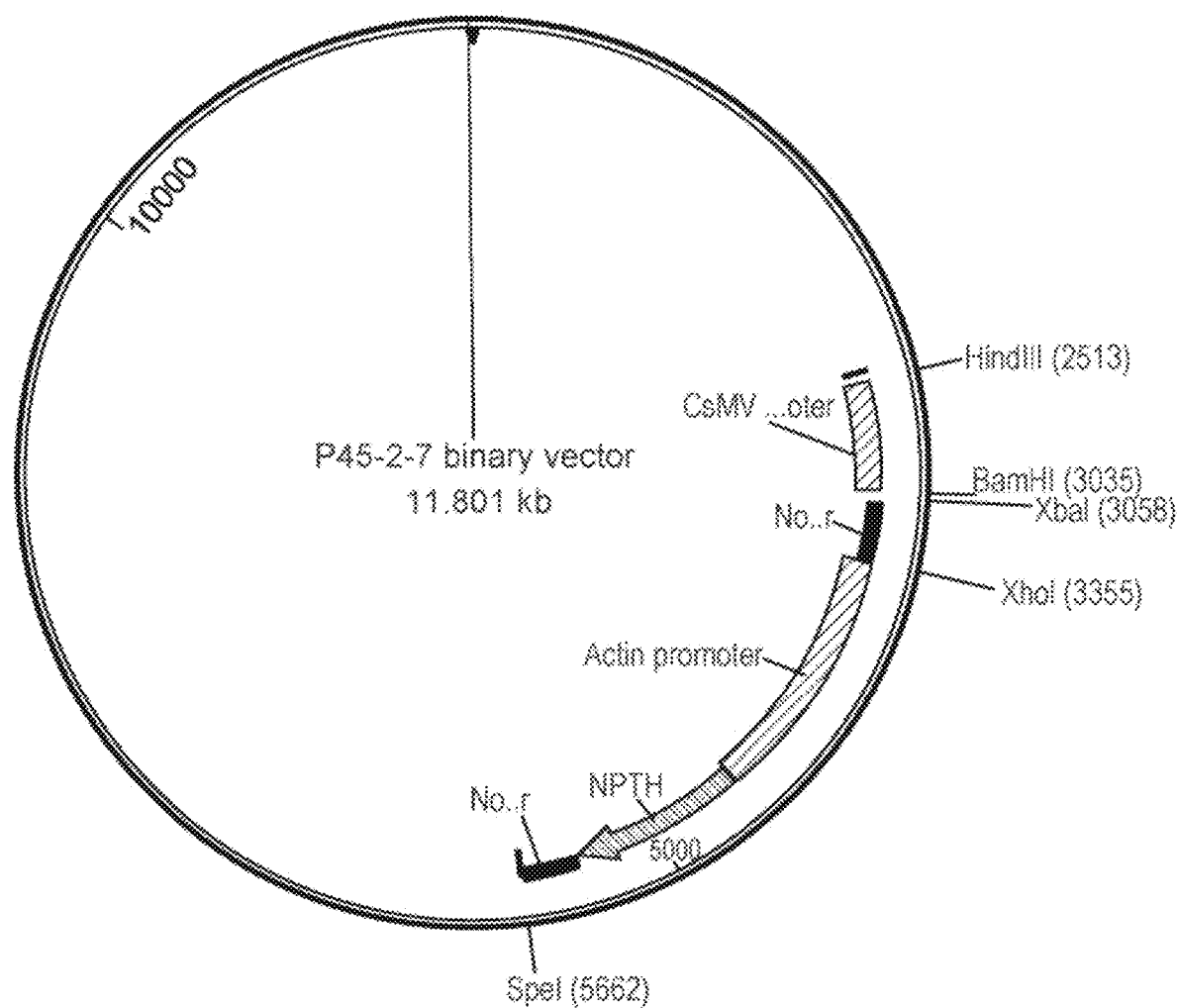
FIG. 1 is a plasmid map of binary vector p45-2-7 (SEQ ID NO: 112).

Unless defined otherwise, all technical and scientific terms used have the same meaning as commonly understood by one of ordinary skill in the art to which this disclosure belongs. Where a term is provided in the singular, the inventors also contemplate aspects of the disclosure described by the plural of that term. Where there are discrepancies in terms and definitions used in references that are incorporated by reference, the terms used in this application shall have the definitions given herein. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" (6th edition, 2002, McGraw-Hill, New York), or the "Oxford Dictionary of Biology" (6th edition, 2008, Oxford University Press, Oxford and New York).

Any references cited herein, including, e.g., all patents, published patent applications, and non-patent publications, are incorporated herein by reference in their entirety.

When a grouping of alternatives is presented, any and all combinations of the members that make up that grouping of alternatives is specifically envisioned. For example, if an item is selected from a group consisting of A, B, C, and D, the inventors specifically envision each alternative individually (e.g., A alone, B alone, etc.), as well as combinations such as A, B, and D; And C; B and C; etc. The term "and/or" when used in a list of two or more items means any one of the listed items by itself or in combination with any one or more of the other listed items. For example, the expression "A and/or B" is intended to mean either or both of A and B—i.e., A alone, B alone, or A and B in combination. The expression "A, B and/or C" is intended to mean A alone, B alone, C alone, A and B in combination, A and C in combination, B and C in combination, or A, B, and C in combination.

When a range of numbers is provided herein, the range is understood to inclusive of the edges of the range as well as any number between the defined edges of the range. For example, "between 1 and 10" includes any number between 1 and 10, as well as the number 1 and the number 10.

As used herein, the singular form "a," "an," and "the" include plural references unless the context clearly dictates otherwise. For example, the term "a compound" or "at least one compound" may include a plurality of compounds, including mixtures thereof.

Any nucleic acid molecule provided herein is envisioned for use with any method provided herein. Any nucleic acid molecule provided herein is envisioned for use with any plant or seed provided herein. Any nucleic acid molecule provided herein is envisioned for use with any tobacco plant or tobacco seed provided herein.

In an aspect, this disclosure provides a nucleic acid molecule comprising a promoter active in axillary bud tissue, where the promoter: (a) comprises a sequence having at least 75% identity to SEQ ID NO: 113, wherein said identity is based on, and limited to, the entire alignable region or regions between said sequence and SEQ ID NO: 113; (b) comprises a deletion of at least 50 contiguous nucleotides as compared to SEQ ID NO: 113; and (c) is operably linked to a heterologous nucleic acid molecule.

The use of the term "polynucleotide" or "nucleic acid molecule" is not intended to limit the present disclosure to polynucleotides comprising deoxyribonucleic acid (DNA). For example, ribonucleic acid (RNA) molecules are also envisioned. Those of ordinary skill in the art will recognize that polynucleotides and nucleic acid molecules can comprise ribonucleotides and combinations of ribonucleotides and deoxyribonucleotides. Such deoxyribonucleotides and ribonucleotides include both naturally occurring molecules and synthetic analogues. The polynucleotides of the present disclosure also encompass all forms of sequences including, but not limited to, single-stranded forms, double-stranded forms, hairpins, stem-and-loop structures, and the like. In an aspect, a nucleic acid molecule provided herein is a DNA molecule. In another aspect, a nucleic acid molecule provided herein is an RNA molecule. In an aspect, a nucleic acid molecule provided herein is single-stranded. In another aspect, a nucleic acid molecule provided herein is double-stranded. A nucleic acid molecule can encode a polypeptide or a non-coding RNA.

In one aspect, a nucleic acid molecule provided herein is a plasmid or vector. In one aspect, a plasmid or vector provided herein is a recombinant vector. As used herein, the term "recombinant vector" refers to a vector formed by laboratory methods of genetic recombination, such as molecular cloning. In another aspect, a plasmid provided herein is a synthetic plasmid. As used herein, a "synthetic plasmid" is an artificially created plasmid that is capable of the same functions (e.g., replication) as a natural plasmid (e.g., Ti plasmid). Without being limited, one skilled in the art can create a synthetic plasmid de novo via synthesizing a plasmid by individual nucleotides, or by splicing together nucleic acid molecules from different pre-existing plasmids.

As used herein, the terms "vector" or "plasmid" are used interchangeably and refer to a circular, double-stranded DNA molecule that is physically separate from chromosomal DNA. In one aspect, a plasmid or vector used herein is capable of replication in vivo. A "transformation vector," as used herein, is a plasmid that is capable of transforming a plant cell. In an aspect, a plasmid provided herein is a bacterial plasmid. In another aspect, a plasmid provided herein is an *Agrobacterium* Ti plasmid or derived from an *Agrobacterium* Ti plasmid.

As commonly understood in the art, the term "promoter" refers to a DNA sequence that contains an RNA polymerase binding site, transcription start site, and/or TATA box and assists or promotes the transcription and expression of an associated transcribable polynucleotide sequence and/or gene (or transgene). A promoter can be synthetically produced, varied or derived from a known or naturally occurring promoter sequence or other promoter sequence. A promoter can also include a chimeric promoter comprising a combination of two or more heterologous sequences. A promoter of the present application can thus include variants of promoter sequences that are similar in composition, but not identical to, other promoter sequence(s) known or provided herein.

It is understood in the art that promoters can comprise one or more "elements" that play important roles in determining when, where, and for how long a promoter is active. As used herein, an "active" promoter refers to a promoter that is initiating transcription of an operably linked nucleic acid molecule at a detectable level. One of skill in the art can determine if a promoter is active or not via any one of several methods known in the art. For example, exemplary methods of determining if a promoter is active include reverse-transcriptase polymerase chain reaction (RT-PCR), quantitative RT-PCR, and RNA sequencing. These, and other suitable methods, can be used to determine if a promoter is active by detecting the accumulation of RNA transcripts of a nucleic acid molecule operably linked to the promoter. Similarly, the activity of a promoter can be operably linked to a visual marker, such as, for example, genes encoding β-glucuronidase, luciferase, or green fluorescent protein, to determine if a promoter is active. Presence of the visual marker in a tissue sample indicates that the promoter is active in that tissue.

In one aspect, a promoter element provided herein is a bud dormancy element (SEQ ID NO: 258). In another aspect, a promoter element provided herein is a sugar repressive element (SEQ ID NO: 259). In another aspect, a promoter element provided herein is an axillary bud up2 element (SEQ ID NO: 260).

In an aspect, a promoter provided herein comprises three or fewer bud dormancy elements. In another aspect, a promoter provided herein comprises two or fewer bud dormancy elements. In another aspect, a promoter provided herein comprises one or zero bud dormancy elements. In an aspect, a promoter provided herein comprises three bud dormancy elements. In an aspect, a promoter provided herein comprises two bud dormancy elements. In an aspect, a promoter provided herein comprises one bud dormancy element. In another aspect, a promoter provided herein comprises zero bud dormancy elements. In another aspect, a promoter provided herein comprises at least three bud dormancy elements. In another aspect, a promoter provided herein comprises at least five bud dormancy elements. In another aspect, a promoter provided herein comprises between zero and five bud dormancy elements. In another aspect, a promoter provided herein comprises between zero and four bud dormancy elements. In another aspect, a promoter provided herein comprises between zero and three bud dormancy elements. In another aspect, a promoter provided herein comprises between zero and two bud dormancy elements. In another aspect, a promoter provided herein comprises between one and five bud dormancy elements. In another aspect, a promoter provided herein comprises between one and four bud dormancy elements. In another aspect, a promoter provided herein comprises between one and three bud dormancy elements. In another aspect, a promoter provided herein comprises between two and five bud dormancy elements. In another aspect, a promoter provided herein comprises between one and four bud dormancy elements.

In an aspect, a promoter provided herein comprises three or fewer sugar repressive elements. In another aspect, a promoter provided herein comprises two or fewer sugar repressive elements. In another aspect, a promoter provided herein comprises one or zero sugar repressive elements. In an aspect, a promoter provided herein comprises three sugar repressive elements. In an aspect, a promoter provided herein comprises two sugar repressive elements. In an aspect, a promoter provided herein comprises one sugar repressive element. In another aspect, a promoter provided herein comprises zero sugar repressive elements. In another aspect, a promoter provided herein comprises at least three sugar repressive elements. In another aspect, a promoter provided herein comprises at least five sugar repressive elements. In another aspect, a promoter provided herein comprises between zero and five sugar repressive elements. In another aspect, a promoter provided herein comprises between zero and four sugar repressive elements. In another aspect, a promoter provided herein comprises between zero and three sugar repressive elements. In another aspect, a promoter provided herein comprises between zero and two sugar repressive elements. In another aspect, a promoter provided herein comprises between one and five sugar repressive elements. In another aspect, a promoter provided herein comprises between one and four sugar repressive elements. In another aspect, a promoter provided herein comprises between one and three sugar repressive elements. In another aspect, a promoter provided herein comprises between two and five sugar repressive elements. In another aspect, a promoter provided herein comprises between one and four sugar repressive elements.

In another aspect, a promoter provided herein comprises one or zero axillary bud up2 elements. In another aspect, a promoter provided herein comprises one axillary bud up2 element. In another aspect, a promoter provided herein comprises zero axillary bud up2 elements. In another aspect, a promoter provided herein comprises at least one axillary bud up2 element. In another aspect, a promoter provided herein comprises at least two axillary bud up2 elements. In another aspect, a promoter provided herein comprises at least five axillary bud up2 elements. In another aspect, a promoter provided herein comprises between one and five axillary bud up2 elements. In another aspect, a promoter provided herein comprises between one and four axillary bud up2 elements. In another aspect, a promoter provided herein comprises between one and three axillary bud up2 elements.

As used herein, "operably linked" refers to a functional linkage between two or more elements. For example, an operable linkage between a polynucleotide of interest and a regulatory sequence (e.g., a promoter) is a functional link that allows for expression of the polynucleotide of interest. Operably linked elements may be contiguous or non-contiguous. In an aspect, a promoter provided herein is operably linked to a heterologous nucleic acid molecule. In another aspect, a promoter provided herein is operably linked to a heterologous nucleic acid molecule encoding at least one axillary bud-degrading product.

As used herein, the term "heterologous" refers to a combination of two or more DNA molecules or sequences, such as a promoter and an associated transcribable DNA sequence, coding sequence or gene, when such a combination is man-made and not normally found in nature.

The terms "percent identity" or "percent identical" as used herein in reference to two or more nucleotide or protein sequences is calculated by (i) comparing two optimally aligned sequences (nucleotide or protein) over a window of comparison (the "alignable" region or regions), (ii) determining the number of positions at which the identical nucleic acid base (for nucleotide sequences) or amino acid residue (for proteins) occurs in both sequences to yield the number of matched positions, (iii) dividing the number of matched positions by the total number of positions in the window of comparison, and then (iv) multiplying this quotient by 100% to yield the percent identity. If the "percent identity" is being calculated in relation to a reference sequence without a particular comparison window being specified, then the percent identity is determined by dividing the number of matched positions over the region of alignment by the total length of the reference sequence. Accordingly, for purposes of the present application, when two sequences (query and subject) are optimally aligned (with allowance for gaps in their alignment), the "percent identity" for the query sequence is equal to the number of identical positions between the two sequences divided by the total number of positions in the query sequence over its length (or a comparison window), which is then multiplied by 100%. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity can be adjusted upwards to correct for the conservative nature of the substitution. Sequences that differ by such conservative substitutions are said to have "sequence similarity" or "similarity."

For optimal alignment of sequences to calculate their percent identity, various pair-wise or multiple sequence alignment algorithms and programs are known in the art, such as ClustalW or Basic Local Alignment Search Tool® (BLAST™), etc., that can be used to compare the sequence identity or similarity between two or more nucleotide or protein sequences. Although other alignment and comparison methods are known in the art, the alignment and percent identity between two sequences (including the percent identity ranges described above) can be as determined by the ClustalW algorithm, see, e.g., Chenna et al., "Multiple sequence alignment with the Clustal series of programs," *Nucleic Acids Research* 31: 3497-3500 (2003); Thompson et al., "Clustal W: Improving the sensitivity of progressive multiple sequence alignment through sequence weighting, position-specific gap penalties and weight matrix choice," *Nucleic Acids Research* 22: 4673-4680 (1994); Larkin M A et al., "Clustal W and Clustal X version 2.0," *Bioinformatics* 23: 2947-48 (2007); and Altschul et al. "Basic local alignment search tool." *J. Mol. Biol.* 215:403-410 (1990), the entire contents and disclosures of which are incorporated herein by reference.

When two sequences are optimally aligned, the alignment may produce a gap, where one sequence appears to be "missing" nucleotides as compared to the other sequences. Such a gap is referred to as a "deletion." A deletion can be internal (e.g., the two sequences align to each other on both sides of the deletion) or external (e.g., the two sequences align to each other on only one side of the deletion).

In an aspect, a promoter provided herein comprises a nucleic acid sequence at least 85% identical to SEQ ID NO: 257. In an aspect, a promoter provided herein comprises a nucleic acid sequence at least 90% identical to SEQ ID NO: 257. In an aspect, a promoter provided herein comprises a nucleic acid sequence at least 91% identical to SEQ ID NO: 257. In an aspect, a promoter provided herein comprises a nucleic acid sequence at least 92% identical to SEQ ID NO: 257. In an aspect, a promoter provided herein comprises a nucleic acid sequence at least 93% identical to SEQ ID NO: 257. In an aspect, a promoter provided herein comprises a nucleic acid sequence at least 94% identical to SEQ ID NO: 257. In an aspect, a promoter provided herein comprises a nucleic acid sequence at least 95% identical to SEQ ID NO: 257. In an aspect, a promoter provided herein comprises a nucleic acid sequence at least 96% identical to SEQ ID NO: 257. In an aspect, a promoter provided herein comprises a nucleic acid sequence at least 97% identical to SEQ ID NO: 257. In an aspect, a promoter provided herein comprises a nucleic acid sequence at least 98% identical to SEQ ID NO: 257. In an aspect, a promoter provided herein comprises a nucleic acid sequence at least 99% identical to SEQ ID NO: 257. In an aspect, a promoter provided herein comprises a nucleic acid sequence at least 99.5% identical to SEQ ID NO: 257. In an aspect, a promoter provided herein comprises SEQ ID NO: 257. In another aspect, a promoter provided herein consists essentially of SEQ ID NO: 257. In another aspect, a promoter provided herein consists of SEQ ID NO: 257.

In an aspect, a promoter provided herein comprises a deletion of at least 1 nucleotide as compared to SEQ ID NO: 113. In another aspect, a promoter provided herein comprises a deletion of at least 5 contiguous nucleotides as compared to SEQ ID NO: 113. In another aspect, a promoter provided herein comprises a deletion of at least 10 contiguous nucleotides as compared to SEQ ID NO: 113. In another aspect, a promoter provided herein comprises a deletion of at least 25 contiguous nucleotides as compared to SEQ ID NO: 113. In another aspect, a promoter provided herein comprises a deletion of at least 50 contiguous nucleotides as compared to SEQ ID NO: 113. In another aspect, a promoter provided herein comprises a deletion of at least 75 contiguous nucleotides as compared to SEQ ID NO: 113. In another aspect, a promoter provided herein comprises a deletion of at least 100 contiguous nucleotides as compared to SEQ ID NO: 113. In another aspect, a promoter provided herein comprises a deletion of at least 150 contiguous nucleotides as compared to SEQ ID NO: 113. In another aspect, a promoter provided herein comprises a deletion of at least 200 contiguous nucleotides as compared to SEQ ID NO: 113. In another aspect, a promoter provided herein comprises a deletion of at least 250 contiguous nucleotides as compared to SEQ ID NO: 113. In another aspect, a promoter provided herein comprises a deletion of at least 300 contiguous nucleotides as compared to SEQ ID NO: 113. In another aspect, a promoter provided herein comprises a deletion of at least 350 contiguous nucleotides as compared to SEQ ID NO: 113. In another aspect, a promoter provided herein comprises a deletion of at least 400 contiguous nucleotides as compared to SEQ ID NO: 113. In another aspect, a promoter provided herein comprises a deletion of at least 450 contiguous nucleotides as compared to SEQ ID NO: 113. In another aspect, a promoter provided herein comprises a deletion of at least 500 contiguous nucleotides as compared to SEQ ID NO: 113. In another aspect, a promoter provided herein comprises a deletion of at least 600 contiguous nucleotides as compared to SEQ ID NO: 113. In another aspect, a promoter provided herein comprises a deletion of at least 700 contiguous nucleotides as compared to SEQ ID NO: 113. In another aspect, a promoter provided herein comprises a deletion of at least 800 contiguous nucleotides as compared to SEQ ID NO: 113. In another aspect, a promoter provided herein comprises a deletion of at least 900 contiguous nucleotides as compared to SEQ ID NO: 113. In another aspect, a promoter provided herein comprises a deletion of at least 1000 contiguous nucleotides as compared to SEQ ID NO: 113. In another aspect, a promoter provided herein comprises a deletion of at least 1250 contiguous nucleotides as compared to SEQ ID NO: 113. In another aspect, a promoter provided herein comprises a deletion of at least 1500 contiguous nucleotides as compared to SEQ ID NO: 113. In another aspect, a promoter provided herein comprises a deletion of at least 1750 contiguous nucleotides as compared to SEQ ID NO: 113. In another aspect, a promoter provided herein comprises a deletion of at least 2000 contiguous nucleotides as compared to SEQ ID NO: 113. In another aspect, a promoter provided herein comprises a deletion of at least 2250 contiguous nucleotides as compared to SEQ ID NO: 113.

In an aspect, a promoter provided herein comprises a deletion of at least one sugar repressive element. In another aspect, a promoter provided herein comprises a deletion of at least one sugar repressive element as compared to SEQ ID NO: 113. In another aspect, a deletion provided herein comprises the deletion of at least one sugar repressive element. In another aspect, a deletion provided herein comprises the deletion of at least one sugar repressive element as compared to SEQ ID NO: 113. In an aspect, a promoter provided herein comprises a deletion of at least two sugar repressive elements. In another aspect, a promoter provided herein comprises a deletion of at least two sugar repressive elements as compared to SEQ ID NO: 113. In another aspect, a deletion provided herein comprises the deletion of at least two sugar repressive elements. In another aspect, a deletion provided herein comprises the deletion of at least two sugar repressive elements as compared to SEQ ID NO: 113. In an aspect, a promoter provided herein comprises a deletion of at least three sugar repressive elements. In another aspect, a promoter provided herein comprises a deletion of at least three sugar repressive elements as compared to SEQ ID NO: 113. In another aspect, a deletion provided herein comprises the deletion of at least three sugar repressive elements. In another aspect, a deletion provided herein comprises the deletion of at least three sugar repressive elements as compared to SEQ ID NO: 113.

In an aspect, a promoter provided herein comprises a deletion of at least one bud dormancy element. In another aspect, a promoter provided herein comprises a deletion of at least one bud dormancy element as compared to SEQ ID NO: 113. In another aspect, a deletion provided herein comprises the deletion of at least one bud dormancy element. In another aspect, a deletion provided herein comprises the deletion of at least one bud dormancy element as compared to SEQ ID NO: 113. In an aspect, a promoter provided herein comprises a deletion of at least two bud dormancy elements. In another aspect, a promoter provided herein comprises a deletion of at least two bud dormancy elements as compared to SEQ ID NO: 113. In another aspect, a deletion provided herein comprises the deletion of at least two bud dormancy elements. In another aspect, a deletion provided herein comprises the deletion of at least two bud dormancy elements as compared to SEQ ID NO: 113. In an aspect, a promoter provided herein comprises a deletion of at least three bud dormancy elements. In another aspect, a promoter provided herein comprises a deletion of at least three bud dormancy elements as compared to SEQ ID NO: 113. In another aspect, a deletion provided herein comprises the deletion of at least three bud dormancy elements. In another aspect, a deletion provided herein comprises the deletion of at least three bud dormancy elements as compared to SEQ ID NO: 113.

In an aspect, a promoter provided herein comprises a deletion of at least one axillary bud up2 element. In another aspect, a promoter provided herein comprises a deletion of at least one axillary bud up2 element as compared to SEQ ID NO: 113. In another aspect, a deletion provided herein comprises the deletion of at least one axillary bud up2 element. In another aspect, a deletion provided herein comprises the deletion of at least one axillary bud up2 element as compared to SEQ ID NO: 113. In an aspect, a promoter provided herein comprises a deletion of at least two axillary bud up2 elements. In another aspect, a promoter provided herein comprises a deletion of at least two axillary bud up2 elements as compared to SEQ ID NO: 113. In another aspect, a deletion provided herein comprises the deletion of at least two axillary bud up2 elements. In another aspect, a deletion provided herein comprises the deletion of at least two axillary bud up2 elements as compared to SEQ ID NO: 113. In an aspect, a promoter provided herein comprises a deletion of at least three axillary bud up2 elements. In another aspect, a promoter provided herein comprises a deletion of at least three axillary bud up2 elements as compared to SEQ ID NO: 113. In another aspect, a deletion provided herein comprises the deletion of at least three axillary bud up2 elements. In another aspect, a deletion provided herein comprises the deletion of at least three axillary bud up2 elements as compared to SEQ ID NO: 113.

In an aspect, a promoter provided herein comprises a deletion of at least one sugar repressive element and at least one axillary bud up2 element. In another aspect, a promoter provided herein comprises a deletion of at least one sugar repressive element and at least one axillary bud up2 element as compared to SEQ ID NO: 113. In another aspect, a deletion provided herein comprises the deletion of at least one sugar repressive element and at least one axillary bud up2 element. In another aspect, a deletion provided herein comprises the deletion of at least one sugar repressive element and at least one axillary bud up2 element as compared to SEQ ID NO: 113.

In an aspect, a promoter provided herein comprises a deletion of at least one sugar repressive element and at least one bud dormancy element. In another aspect, a promoter provided herein comprises a deletion of at least one sugar repressive element and at least one bud dormancy element as compared to SEQ ID NO: 113. In another aspect, a deletion provided herein comprises the deletion of at least one sugar repressive element and at least one bud dormancy element. In another aspect, a deletion provided herein comprises the deletion of at least one sugar repressive element and at least one bud dormancy element as compared to SEQ ID NO: 113.

In an aspect, a promoter provided herein comprises a deletion of at least one axillary bud up2 element and at least one bud dormancy element. In another aspect, a promoter provided herein comprises a deletion of at least one axillary bud up2 element and at least one bud dormancy element as compared to SEQ ID NO: 113. In another aspect, a deletion provided herein comprises the deletion of at least one axillary bud up2 element and at least one bud dormancy element. In another aspect, a deletion provided herein comprises the deletion of at least one axillary bud up 2 element and at least one bud dormancy element as compared to SEQ ID NO: 113.

In an aspect, a promoter provided herein comprises a deletion of at least one sugar repressive element, at least one axillary bud up2 element, and at least one bud dormancy element. In another aspect, a promoter provided herein comprises a deletion of at least one sugar repressive element, at least one axillary bud up2 element, and at least one bud dormancy element as compared to SEQ ID NO: 113. In another aspect, a deletion provided herein comprises the deletion of at least one sugar repressive element, at least one axillary bud up2 element, and at least one bud dormancy element. In another aspect, a deletion provided herein comprises the deletion of at least one sugar repressive element, at least one axillary bud up2 element, and at least one bud dormancy element as compared to SEQ ID NO: 113.

In an aspect, a deletion provided herein comprises the deletion of: (a) at least one sugar repressive element; (b) an axillary bud up2 element; (c) at least one bud dormancy element; or (d) any combination of (a), (b), and (c).

The terms "percent complementarity" or "percent complementary" as used herein in reference to two nucleotide sequences is similar to the concept of percent identity but refers to the percentage of nucleotides of a query sequence that optimally base-pair or hybridize to nucleotides a subject sequence when the query and subject sequences are linearly arranged and optimally base paired without secondary folding structures, such as loops, stems or hairpins. Such a percent complementarity can be between two DNA strands, two RNA strands, or a DNA strand and a RNA strand. The "percent complementarity" can be calculated by (i) optimally base-pairing or hybridizing the two nucleotide sequences in a linear and fully extended arrangement (i.e., without folding or secondary structures) over a window of comparison, (ii) determining the number of positions that base-pair between the two sequences over the window of comparison to yield the number of complementary positions, (iii) dividing the number of complementary positions by the total number of positions in the window of comparison, and (iv) multiplying this quotient by 100% to yield the percent complementarity of the two sequences. Optimal base pairing of two sequences can be determined based on the known pairings of nucleotide bases, such as G-C, A-T, and A-U, through hydrogen binding. If the "percent complementarity" is being calculated in relation to a reference sequence without specifying a particular comparison window, then the percent identity is determined by dividing the number of complementary positions between the two linear sequences by the total length of the reference sequence. Thus, for purposes of the present application, when two sequences (query and subject) are optimally base-paired (with allowance for mismatches or non-base-paired nucleotides), the "percent complementarity" for the query sequence is equal to the number of base-paired positions between the two sequences divided by the total number of positions in the query sequence over its length, which is then multiplied by 100%.

In one aspect, a promoter provided herein comprises a sequence having at least 75% identity to SEQ ID NO: 113, wherein said identity is based on, and limited to, the entire alignable region or regions between said sequence and SEQ ID NO: 113. In one aspect, a promoter provided herein comprises a sequence having at least 80% identity to SEQ ID NO: 113, wherein said identity is based on, and limited to, the entire alignable region or regions between said sequence and SEQ ID NO: 113. In one aspect, a promoter provided herein comprises a sequence having at least 85% identity to SEQ ID NO: 113, wherein said identity is based on, and limited to, the entire alignable region or regions between said sequence and SEQ ID NO: 113. In one aspect, a promoter provided herein comprises a sequence having at least 90% identity to SEQ ID NO: 113, wherein said identity is based on, and limited to, the entire alignable region or regions between said sequence and SEQ ID NO: 113. In one aspect, a promoter provided herein comprises a sequence having at least 95% identity to SEQ ID NO: 113, wherein said identity is based on, and limited to, the entire alignable region or regions between said sequence and SEQ ID NO: 113. In one aspect, a promoter provided herein comprises a sequence having 100% identity to SEQ ID NO: 113, wherein said identity is based on, and limited to, the entire alignable region or regions between said sequence and SEQ ID NO: 113.

In an aspect, a promoter provided herein comprises between 50 nucleotides and 2450 nucleotides. In another aspect, a promoter provided herein comprises between 100 nucleotides and 2450 nucleotides. In another aspect, a promoter provided herein comprises between 250 nucleotides and 2450 nucleotides. In another aspect, a promoter provided herein comprises between 500 nucleotides and 2450 nucleotides. In another aspect, a promoter provided herein comprises between 1000 nucleotides and 2450 nucleotides. In another aspect, a promoter provided herein comprises between 2000 nucleotides and 2450 nucleotides.

In an aspect, a promoter provided herein comprises at least 50 nucleotides. In another aspect, a promoter provided herein comprises at least 75 nucleotides. In another aspect, a promoter provided herein comprises at least 100 nucleotides. In another aspect, a promoter provided herein comprises at least 200 nucleotides. In another aspect, a promoter provided herein comprises at least 300 nucleotides. In another aspect, a promoter provided herein comprises at least 400 nucleotides. In another aspect, a promoter provided herein comprises at least 500 nucleotides. In another aspect, a promoter provided herein comprises at least 600 nucleotides. In another aspect, a promoter provided herein comprises at least 700 nucleotides. In another aspect, a promoter provided herein comprises at least 800 nucleotides. In another aspect, a promoter provided herein comprises at least 900 nucleotides. In another aspect, a promoter provided herein comprises at least 1000 nucleotides. In another aspect, a promoter provided herein comprises at least 1100 nucleotides. In another aspect, a promoter provided herein comprises at least 1200 nucleotides. In another aspect, a promoter provided herein comprises at least 1300 nucleotides. In another aspect, a promoter provided herein comprises at least 1400 nucleotides. In another aspect, a promoter provided herein comprises at least 1500 nucleotides. In another aspect, a promoter provided herein comprises at least 1600 nucleotides. In another aspect, a promoter provided herein comprises at least 1700 nucleotides. In another aspect, a promoter provided herein comprises at least 1800 nucleotides. In another aspect, a promoter provided herein comprises at least 1900 nucleotides. In another aspect, a promoter provided herein comprises at least 2000 nucleotides. In another aspect, a promoter provided herein comprises at least 2100 nucleotides. In another aspect, a promoter provided herein comprises at least 2200 nucleotides. In another aspect, a promoter provided herein comprises at least 2300 nucleotides. In another aspect, a promoter provided herein comprises at least 2400 nucleotides.

As used herein, an "axillary bud-degrading product" refers to any nucleic acid or protein that can function to inhibit the growth and/or development of an axillary bud. In one aspect, this disclosure provides a nucleic acid molecule that encodes at least one axillary bud-degrading product. In an aspect, an axillary bud-degrading product inhibits the grown of an axillary bud. In another aspect, an axillary bud-degrading product inhibits the development of an axillary bud. Without being limiting, inhibiting the development of an axillary bud can comprise slowing the progression of normal development or stopping an axillary bud from continuing normal development. In an aspect, an axillary bud-degrading product comprises an RNA. In another aspect, an axillary bud-degrading product comprises a polypeptide. In another aspect, an axillary bud-degrading product comprises a small RNA molecule. In an aspect, an axillary bud-degrading product is selected from the group consisting of a small RNA molecule and a polypeptide. In an aspect, a nucleic acid molecule provided herein encodes an axillary bud-degrading product. In another aspect, a heterologous nucleic acid provided herein encodes at least one axillary bud-degrading product.

As used herein, the term "polypeptide" refers to a chain of at least two covalently linked amino acids. Polypeptides can be encoded by polynucleotides provided herein. An example of a polypeptide is a protein. Proteins provided herein can be encoded by nucleic acid molecules provided herein.

In an aspect, a polypeptide provided herein comprises an amino acid sequence at least 70% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 75% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 80% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 85% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 90% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 95% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In an aspect, a polypeptide provided herein comprises an amino acid sequence at least 70% similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 75% similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 80% similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 85% similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 90% similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence at least 95% similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a polypeptide provided herein comprises an amino acid sequence 100% similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

As used herein, a "small RNA molecule" refers to any non-coding RNA molecule. In an aspect, a small RNA molecule is between 18 nucleotides and 30 nucleotides in length. In another aspect, a small RNA molecule is between 18 nucleotides and 24 nucleotides in length. In another aspect, a small RNA molecule is between 18 nucleotides and 22 nucleotides in length. In another aspect, a small RNA molecule is 18 nucleotides in length. In another aspect, a small RNA molecule is 19 nucleotides in length. In another aspect, a small RNA molecule is 20 nucleotides in length. In another aspect, a small RNA molecule is 21 nucleotides in length. In another aspect, a small RNA molecule is 22 nucleotides in length. In another aspect, a small RNA molecule is 23 nucleotides in length. In another aspect, a small RNA molecule is 24 nucleotides in length. In another aspect, a small RNA molecule is 25 nucleotides in length. In another aspect, a small RNA molecule is 26 nucleotides in length. In another aspect, a small RNA molecule is 27 nucleotides in length. In another aspect, a small RNA molecule is 28 nucleotides in length. In another aspect, a small RNA molecule is at least 18 nucleotides in length. In another aspect, a small RNA molecule is at least 19 nucleotides in length. In another aspect, a small RNA molecule is at least 20 nucleotides in length. In another aspect, a small RNA molecule is at least 21 nucleotides in length. In another aspect, a small RNA molecule is at least 22 nucleotides in length. In another aspect, a small RNA molecule is at least 23 nucleotides in length. In another aspect, a small RNA molecule is at least 24 nucleotides in length. In another aspect, a small RNA molecule is at least 25 nucleotides in length. In another aspect, a small RNA molecule is at least 26 nucleotides in length. In another aspect, a small RNA molecule is at least 27 nucleotides in length. In another aspect, a small RNA molecule is at least 28 nucleotides in length.

In an aspect, a small RNA molecule provided herein is a microRNA (miRNA). In another aspect, a small RNA molecule provided herein is a small interfering RNA (siRNA). In another aspect, a small RNA molecule provided herein is a heterochromatic siRNA (hc-siRNA). In another aspect, a small RNA molecule provided herein is a Piwi-interacting RNA (piRNA). In another aspect, a small RNA molecule provided herein is a hairpin double-stranded RNA (hp-dsRNA). In another aspect, a small RNA molecule provided herein is a trans-acting siRNA (ta-siRNA). In another aspect, a small RNA molecule provided herein is a naturally occurring antisense siRNA (nat-siRNA). In another aspect, a small RNA molecule provided herein is a Cas9-guide RNA (gRNA). In another aspect, a small RNA molecule provided herein is a Cpf1-gRNA. In another aspect, a small RNA molecule provided herein is a CasX-gRNA. In another aspect, a small RNA molecule provided herein is a Csm1-gRNA.

In an aspect, a small RNA molecule provided herein comprises at least 18 contiguous nucleotides identical or complementary to a polynucleotide selected from the group consisting of SEQ ID NOs: 83-101. In another aspect, a small RNA molecule provided herein comprises at least 19 contiguous nucleotides identical or complementary to a polynucleotide selected from the group consisting of SEQ ID NOs: 83-101. In another aspect, a small RNA molecule provided herein comprises at least 20 contiguous nucleotides identical or complementary to a polynucleotide selected from the group consisting of SEQ ID NOs: 83-101. In another aspect, a small RNA molecule provided herein comprises at least 21 contiguous nucleotides identical or complementary to a polynucleotide selected from the group consisting of SEQ ID NOs: 83-101. In another aspect, a small RNA molecule provided herein comprises at least 22 contiguous nucleotides identical or complementary to a polynucleotide selected from the group consisting of SEQ ID NOs: 83-101. In another aspect, a small RNA molecule provided herein comprises at least 23 contiguous nucleotides identical or complementary to a polynucleotide selected from the group consisting of SEQ ID NOs: 83-101. In another aspect, a small RNA molecule provided herein comprises at least 24 contiguous nucleotides identical or complementary to a polynucleotide selected from the group consisting of SEQ ID NOs: 83-101. In another aspect, a small RNA molecule provided herein comprises at least 25 contiguous nucleotides identical or complementary to a polynucleotide selected from the group consisting of SEQ ID NOs: 83-101. In another aspect, a small RNA molecule provided herein comprises at least 26 contiguous nucleotides identical or complementary to a polynucleotide selected from the group consisting of SEQ ID NOs: 83-101. In another aspect, a small RNA molecule provided herein comprises at least 27 contiguous nucleotides identical or complementary to a polynucleotide selected from the group consisting of SEQ ID NOs: 83-101. In another aspect, a small RNA molecule provided herein comprises at least 28 contiguous nucleotides identical or complementary to a polynucleotide selected from the group consisting of SEQ ID NOs: 83-101.

In one aspect, this disclosure provides a tobacco plant comprising a nucleic acid molecule comprising a promoter active in axillary bud tissue, where the promoter: (a) comprises a sequence having at least 75% identity to SEQ ID NO: 113, where the identity is based on, and limited to, the entire alignable region or regions between the sequence and SEQ ID NO: 113; (b) comprises a deletion of at least 50 contiguous nucleotides as compared to SEQ ID NO: 113; and (c) is operably linked to a heterologous nucleic acid molecule, where the tobacco plant comprises no suckers or reduced suckers after topping as compared to a control tobacco plant of the same variety when grown under comparable conditions.

In another aspect, this disclosure provides a plant comprising a nucleic acid molecule comprising a promoter active in axillary bud tissue, where the promoter: (a) comprises a sequence having at least 75% identity to SEQ ID NO: 113, where the identity is based on, and limited to, the entire alignable region or regions between the sequence and SEQ ID NO: 113; (b) comprises a deletion of at least 50 contiguous nucleotides as compared to SEQ ID NO: 113; and (c) is operably linked to a heterologous nucleic acid molecule, where the plant comprises no suckers or reduced suckers after topping as compared to a control plant of the same variety when grown under comparable conditions.

In yet another aspect, this disclosure provides a plant or seed comprising a nucleic acid molecule, where the nucleic acid molecule comprises a promoter active in axillary bud tissue, where the promoter: (a) comprises a sequence having at least 75% identity to SEQ ID NO: 113, where the identity is based on, and limited to, the entire alignable region or regions between the sequence and SEQ ID NO: 113; (b) comprises a deletion of at least 50 contiguous nucleotides as compared to SEQ ID NO: 113; and (c) is operably linked to a heterologous nucleic acid molecule encoding an axillary bud-degrading product. In an aspect, a plant provided herein comprises no or reduced suckers as compared to a control plant when grown under comparable conditions.

As used herein, "plant" refers to a whole plant. A cell or tissue culture derived from a plant can comprise any plant components or plant organs (e.g., leaves, stems, roots, etc.), plant tissues, seeds, plant cells, and/or progeny of the same. A progeny plant can be from any filial generation, e.g., $F_1$, $F_2$, $F_3$, $F_4$, $F_5$, $F_6$, $F_7$, etc. A plant cell is a biological cell of a plant, taken from a plant or derived through culture from a cell taken from a plant. As used herein, "seedling" refers to a plant that is equal to, or less than, 14 days post-germination.

In one aspect, a plant component provided herein includes, but is not limited to, a leaf, a stem, a root, a seed, a flower, pollen, an anther, an ovule, a pedicel, a fruit, a meristem, a cotyledon, a hypocotyl, a pod, an embryo, endosperm, an explant, a callus, a tissue culture, a shoot, a cell, and a protoplast. In further aspects, this disclosure provides plant cells, tissues, and organs that are not reproductive material and do not mediate the natural reproduction of the plant. In another aspect, this disclosure also provides plant cells, tissues, and organs that are reproductive material and mediate the natural reproduction of the plant. In another aspect, this disclosure provides plant cells, tissues, and organs that cannot maintain themselves via photosynthesis. In another aspect, this disclosure provides somatic plant cells. Somatic cells, contrary to germline cells, do not mediate plant reproduction.

Provided cells, tissues and organs can be from seed, fruit, leaf, cotyledon, hypocotyl, meristem, embryos, endosperm, root, shoot, stem, pod, flower, inflorescence, stalk, pedicel, style, stigma, receptacle, petal, sepal, pollen, anther, filament, ovary, ovule, pericarp, phloem, and vascular tissue. In another aspect, this disclosure provides a plant chloroplast. In a further aspect, this disclosure provides an epidermal cell, a stomata cell, a trichome cell, a root hair, or a storage root.

In an aspect, this disclosure provides a tobacco protoplast cell. In another aspect, this disclosure provides a tobacco callus cell. In another aspect, this disclosure provides a tobacco seed cell. In another aspect, this disclosure provides a tobacco seed cell. In another aspect, this disclosure provides a tobacco fruit cell. In another aspect, this disclosure provides a tobacco leaf cell. In another aspect, this disclosure provides a tobacco cotyledon cell. In another aspect, this disclosure provides a tobacco hypocotyl cell. In another aspect, this disclosure provides a tobacco meristem cell. In another aspect, this disclosure provides a tobacco embryo cell. In another aspect, this disclosure provides a tobacco root cell. In another aspect, this disclosure provides a tobacco shoot cell. In another aspect, this disclosure provides a tobacco stem cell. In another aspect, this disclosure provides a tobacco flower cell. In another aspect, this disclosure provides a tobacco inflorescence cell. In another aspect, this disclosure provides a tobacco stalk cell. In another aspect, this disclosure provides a tobacco pedicel cell. In another aspect, this disclosure provides a tobacco style cell. In another aspect, this disclosure provides a tobacco stigma cell. In another aspect, this disclosure provides a tobacco receptacle cell. In another aspect, this disclosure provides a tobacco petal cell. In another aspect, this disclosure provides a tobacco sepal cell. In another aspect, this disclosure provides a tobacco pollen cell. In another aspect, this disclosure provides a tobacco anther cell. In another aspect, this disclosure provides a tobacco filament cell. In another aspect, this disclosure provides a tobacco ovary cell. In another aspect, this disclosure provides a tobacco ovule cell. In another aspect, this disclosure provides a tobacco pericarp cell. In another aspect, this disclosure provides a tobacco phloem cell.

Tobacco is known in the art as a plant from the family Solanaceae. Non-limiting exemplary tobacco species include *Nicotiana acuminata, Nicotiana africana, Nicotiana alata, Nicotiana attenuata, Nicotiana benthamiana, Nicotiana clevelandii, Nicotiana exigua, Nicotiana glauca, Nicotiana glutinosa, Nicotiana langsdorffii, Nicotiana longiflora, Nicotiana occidentalis, Nicotiana obtusifolia, Nicotiana otophora, Nicotiana plumbaginifolia, Nicotiana quadrivalvis, Nicotiana rustica, Nicotiana suaveolens, Nicotiana sylvestris, Nicotiana tabacum*, and *Nicotiana tomentosiformis*. In one aspect, tobacco refers to *Nicotiana tabacum*.

In an aspect, a plant provided herein is a tobacco plant. In another aspect, a seed provided herein is a tobacco seed. In another aspect, a leaf provided herein is a tobacco leaf. In another aspect, a plant cell provided herein is a tobacco cell. In another aspect, a plant tissue provided herein is a tobacco tissue. In another aspect, a plant organ provided herein is a tobacco organ. In a further aspect, a plant component provided herein is a tobacco component.

In an aspect, a plant provided herein is a modified plant. In another aspect, a seed provided herein is a modified seed. In a further aspect, a plant component provided herein is a modified plant component. In an aspect, a plant cell provided herein is a modified plant cell. In another aspect, a plant genome provided herein is a modified plant genome. As used herein, "modified" refers to plants, seeds, plant components, plant cells, and plant genomes that have been subjected to mutagenesis, genome editing, genetic transformation, or a combination thereof. In an aspect, this disclosure provides a tobacco plant. In another aspect, this disclosure provides a tobacco seed. In a further aspect, this disclosure provides a tobacco leaf. In still a further aspect, this disclosure provides a modified cured tobacco leaf.

In an aspect, this disclosure provides a tobacco plant comprising any nucleic acid molecule provided herein. In another aspect, this disclosure provides a tobacco seed comprising any nucleic acid molecule provided herein. In a further aspect, this disclosure provides a tobacco leaf comprising any nucleic acid molecule provided herein. In still a further aspect, this disclosure provides a cured tobacco leaf comprising any nucleic acid molecule provided herein. In an aspect, this disclosure provides a plant comprising any nucleic acid molecule provided herein. In another aspect, this disclosure provides a seed comprising any nucleic acid molecule provided herein. In a further aspect, this disclosure provides a leaf comprising any nucleic acid molecule provided herein.

As used herein, "suckering" refers to the development and/or growth of axillary (or lateral) buds ("suckers") from axillary meristems that grow between a leaf and the stalk. An axillary bud is an embryonic shoot that comprises an axillary meristem, surrounding leaf tissue, and surrounding stem tissue. In one aspect, suckering is induced by topping a plant.

Dicot shoot apical and axillary meristems comprise three distinct cell layers: the L1 layer (outermost layer), the L2 layer (middle layer), and the L3 layer (innermost layer). The L1 and L2 layers make up the tunica, and they divide anticlinally (the division plane is perpendicular to the surface of the meristem). The L3 layer, or corpus, divides in all directions. The L1 layer eventually gives rise to epidermal tissue; the L2 layer gives rise to ground tissue (e.g., parenchyma, collenchyma, sclerenchyma); and the L3 layer typically gives rise to vascular tissue (e.g., xylem, phloem).

Shoot apical and axillary meristems have two main functions: to maintain themselves as a group of pluripotent cells, and to generate lateral above-ground organs of the plant (e.g., stems, leaves, flowers). If a meristem fails to maintain itself, for any reason, it will eventually exhaust its pluripotent cells and cease giving rise to additional organs. In one aspect, a tobacco plant provided herein exhibits inhibited or eliminated axillary meristem growth; inhibited or eliminated axillary meristem maintenance; or a combination thereof compared to a control tobacco plant of the same variety when grown under comparable conditions.

In one aspect, a promoter provided herein is active in axillary meristem tissue. In another aspect, a promoter provided herein is active in axillary bud tissue. In an aspect, a promoter provided herein is active in axillary meristem tissue at least 7 days after topping. In another aspect, a promoter provided herein is active in axillary bud tissue at least 7 days after topping. In an aspect, a promoter provided herein is not active in a seedling tobacco plant. In another aspect, a promoter provided herein is not active in a seedling plant. In another aspect, a promoter provided herein is not active in a tobacco seed. In another aspect, a promoter provided herein is not active in a seed. In a further aspect, a promoter provided herein is not active in a tobacco embryo. In another aspect, a promoter provided herein is not active in a plant embryo. In an aspect, a promoter provided herein is not active in a tobacco pollen cell. In another aspect, a promoter provided herein is not active in a pollen cell. In an aspect, a promoter provided herein is not active in a tobacco egg cell. In another aspect, a promoter provided herein is not active in a plant egg cell. In an aspect, a promoter provided herein is not active in shoot apical meristem tissue.

As used herein, "topping" refers to the removal of the stalk apex, including the SAM, flowers, and up to several adjacent leaves, when a plant is near maturity. Topping a tobacco plant results in the loss of apical dominance. Prior to topping, suckering is largely kept dormant by hormonal signals emanating from the SAM; topping removes the hormonal signals and can allow the outgrowth of suckers ("topping-induced suckering"). Provided suckering is sufficiently controlled, topping increases yield, increases value-per-acre, and results in desirable modifications to physical and chemical properties of tobacco leaves.

As used herein, "comparable growth conditions" refers to similar environmental conditions and/or agronomic practices for growing and making meaningful comparisons between two or more plant genotypes so that neither environmental conditions nor agronomic practices would contribute to, or explain, any differences observed between the two or more plant genotypes. Environmental conditions include, for example, light, temperature, water, humidity, and nutrition (e.g., nitrogen and phosphorus). Agronomic practices include, for example, seeding, clipping, undercutting, transplanting, topping, and suckering. See Chapters 4B and 4C of Tobacco, Production, Chemistry and Technology, Davis & Nielsen, eds., Blackwell Publishing, Oxford (1999), pp. 70-103.

As used herein, "reduced topping-induced suckering" or "reduced suckering" refers to a reduction in the number of suckers; a reduction in the size of suckers (e.g., dry biomass, fresh weight, length, diameter), and/or a reduction of the impact suckers have on agronomic performance (e.g., yield, quality and overall productivity of the plant) compared to a control plant when grown under comparable conditions after topping. As used herein, a "reduction" in the number of suckers, the size of suckers, and/or the impact suckers have on agronomic performance refers to a statistically significant reduction. As used herein, "statistically significant" refers to a p-value of less than 0.05 when using an appropriate measure of statistical significance (e.g., a one-tailed two sample t-test).

Unless specified otherwise, measurements of sucker length, sucker biomass, number of suckers, leaf yield, or leaf grade index values mentioned herein for a tobacco plant, variety, cultivar, or line refer to average measurements, including, for example, an average of multiple leaves (e.g., 2, 3, 4, 5, 6, 7, 8, 9, 10, 11, 12, 13, 14, 15, 16, 17, 18, 19, or 20 or more leaves) of a single plant or an average measurement from a population of tobacco plants from a single variety, cultivar, or line. A population of tobacco plants or a collection of tobacco leaves for determining an average measurement (e.g., fresh weight, dry biomass, or leaf grading) can be of any size, for example, 5, 10, 15, 20, 25, 30, 35, 40, or 50. Industry-accepted standard protocols are followed for determining average measurements or grade index values.

In an aspect, reduced suckering comprises a reduction in the dry biomass of suckers. In an aspect, reduced suckering comprises a reduction in the fresh weight of suckers. In another aspect, reduced suckering comprises a reduction in the length of suckers. In still another aspect, reduced suckering comprises a reduction in the number of suckers present. In an aspect, reduced suckering comprises a reduction in the dry biomass of suckers, the reduction in the fresh weight of suckers, a reduction in the length of suckers, a reduction in the diameter of suckers, reduced number of total suckers, or any combination thereof.

In an aspect, the number of suckers is counted one week after topping. In another aspect, the number of suckers is counted two weeks after topping. In another aspect, the number of suckers is counted three weeks after topping. In another aspect, the number of suckers is counted four weeks after topping. In another aspect, the number of suckers is counted five weeks after topping. In another aspect, the number of suckers is counted six weeks after topping. In another aspect, the number of suckers is counted seven weeks after topping. In another aspect, the number of suckers is counted eight weeks after topping. In another aspect, the number of suckers is counted nine weeks after topping. In another aspect, the number of suckers is counted ten weeks after topping.

In an aspect, the fresh weight of suckers is measured one week after topping. In another aspect, the fresh weight of suckers is measured two weeks after topping. In another aspect, the fresh weight of suckers is measured three weeks after topping. In another aspect, the fresh weight of suckers is measured four weeks after topping. In another aspect, the fresh weight of suckers is measured five weeks after topping. In another aspect, the fresh weight of suckers is measured six weeks after topping. In another aspect, the fresh weight of suckers is measured seven weeks after topping. In another aspect, the fresh weight of suckers is measured eight weeks after topping. In another aspect, the fresh weight of suckers is measured nine weeks after topping. In another aspect, the fresh weight of suckers is measured ten weeks after topping.

In an aspect, the dry biomass of suckers is measured one week after topping. In another aspect, the dry biomass of suckers is measured two weeks after topping. In another aspect, the dry biomass of suckers is measured three weeks after topping. In another aspect, the dry biomass of suckers is measured four weeks after topping. In another aspect, the dry biomass of suckers is measured five weeks after topping. In another aspect, the dry biomass of suckers is measured six weeks after topping. In another aspect, the dry biomass of suckers is measured seven weeks after topping. In another aspect, the dry biomass of suckers is measured eight weeks after topping. In another aspect, the dry biomass of suckers is measured nine weeks after topping. In another aspect, the dry biomass of suckers is measured ten weeks after topping.

The length of a sucker is measured as the distance between the sucker base (where it attaches to the main stem of the plant) and the part of the sucker most distant from the sucker base. In an aspect, the length of suckers is measured one week after topping. In another aspect, the length of suckers is measured two weeks after topping. In another aspect, the length of suckers is measured three weeks after topping. In another aspect, the length of suckers is measured four weeks after topping. In another aspect, the length of suckers is measured five weeks after topping. In another aspect, the length of suckers is measured six weeks after topping. In another aspect, the length of suckers is measured seven weeks after topping. In another aspect, the length of suckers is measured eight weeks after topping. In another aspect, the length of suckers is measured nine weeks after topping. In another aspect, the length of suckers is measured ten weeks after topping.

The diameter of a sucker is measured at its base, where it adjoins to the main stem of the plant. In an aspect, the diameter of suckers is measured one week after topping. In another aspect, the diameter of suckers is measured two weeks after topping. In another aspect, the diameter of suckers is measured three weeks after topping. In another aspect, the diameter of suckers is measured four weeks after topping. In another aspect, the diameter of suckers is measured five weeks after topping. In another aspect, the diameter of suckers is measured six weeks after topping. In another aspect, the diameter of suckers is measured seven weeks after topping. In another aspect, the diameter of suckers is measured eight weeks after topping. In another aspect, the diameter of suckers is measured nine weeks after topping. In another aspect, the diameter of suckers is measured ten weeks after topping.

In an aspect, the fresh weight biomass of suckers of a tobacco plant provided herein is at least 10% reduced compared to the fresh weight biomass of suckers of a control tobacco plant grown under comparable conditions. In another aspect, the fresh weight biomass of suckers of a tobacco plant provided herein is at least 15% reduced compared to the fresh weight biomass of suckers of a control tobacco plant grown under comparable conditions. In another aspect, the fresh weight biomass of suckers of a tobacco plant provided herein is at least 20% reduced compared to the fresh weight biomass of suckers of a control tobacco plant grown under comparable conditions. In another aspect, the fresh weight biomass of suckers of a tobacco plant provided herein is at least 25% reduced compared to the fresh weight biomass of suckers of a control tobacco plant grown under comparable conditions. In another aspect, the fresh weight biomass of suckers of a tobacco plant provided herein is at least 30% reduced compared to the fresh weight biomass of suckers of a control tobacco plant grown under comparable conditions. In another aspect, the fresh weight biomass of suckers of a tobacco plant provided herein is at least 35% reduced compared to the fresh weight biomass of suckers of a control tobacco plant grown under comparable conditions. In another aspect, the fresh weight biomass of suckers of a tobacco plant provided herein is at least 40% reduced compared to the fresh weight biomass of suckers of a control tobacco plant grown under comparable conditions. In another aspect, the fresh weight biomass of suckers of a tobacco plant provided herein is at least 45% reduced compared to the fresh weight biomass of suckers of a control tobacco plant grown under comparable conditions. In another aspect, the fresh weight biomass of suckers of a tobacco plant provided herein is at least 50% reduced compared to the fresh weight biomass of suckers of a control tobacco plant grown under comparable conditions. In another aspect, the fresh weight biomass of suckers of a tobacco plant provided herein is at least 55% reduced compared to the fresh weight biomass of suckers of a control tobacco plant grown under comparable conditions. In another aspect, the fresh weight biomass of suckers of a tobacco plant provided herein is at least 60% reduced compared to the fresh weight biomass of suckers of a control tobacco plant grown under comparable conditions. In another aspect, the fresh weight biomass of suckers of a tobacco plant provided herein is at least 65% reduced compared to the fresh weight biomass of suckers of a control tobacco plant grown under comparable conditions. In another aspect, the fresh weight biomass of suckers of a tobacco plant provided herein is at least 70% reduced compared to the fresh weight biomass of suckers of a control tobacco plant grown under comparable conditions. In another aspect, the fresh weight biomass of suckers of a tobacco plant provided herein is at least 75% reduced compared to the fresh weight biomass of suckers of a control tobacco plant grown under comparable conditions. In another aspect, the fresh weight biomass of suckers of a tobacco plant provided herein is at least 80% reduced compared to the fresh weight biomass of suckers of a control tobacco plant grown under comparable conditions. In another aspect, the fresh weight biomass of suckers of a tobacco plant provided herein is at least 85% reduced compared to the fresh weight biomass of suckers of a control tobacco plant grown under comparable conditions. In another aspect, the fresh weight biomass of suckers of a tobacco plant provided herein is at least 90% reduced compared to the fresh weight biomass of suckers of a control tobacco plant grown under comparable conditions. In another aspect, the fresh weight biomass of suckers of a tobacco plant provided herein is at least 95% reduced compared to the fresh weight biomass of suckers of a control tobacco plant grown under comparable conditions.

In an aspect, the fresh weight biomass of suckers of a tobacco plant provided herein is reduced by between 1% and 25% as compared to the fresh weight biomass of suckers of a control tobacco plant grown under comparable conditions. In an aspect, the fresh weight biomass of suckers of a tobacco plant provided herein is reduced by between 1% and 50% as compared to the fresh weight biomass of suckers of a control tobacco plant grown under comparable conditions. In an aspect, the fresh weight biomass of suckers of a tobacco plant provided herein is reduced by between 1% and 75% as compared to the fresh weight biomass of suckers of a control tobacco plant grown under comparable conditions. In an aspect, the fresh weight biomass of suckers of a tobacco plant provided herein is reduced by between 1% and 100% as compared to the fresh weight biomass of suckers of a control tobacco plant grown under comparable conditions. In an aspect, the fresh weight biomass of suckers of a tobacco plant provided herein is reduced by between 5% and 25% as compared to the fresh weight biomass of suckers of a control tobacco plant grown under comparable conditions. In an aspect, the fresh weight biomass of suckers of a tobacco plant provided herein is reduced by between 5% and 50% as compared to the fresh weight biomass of suckers of a control tobacco plant grown under comparable conditions. In an aspect, the fresh weight biomass of suckers of a tobacco plant provided herein is reduced by between 5% and 75% as compared to the fresh weight biomass of suckers of a control tobacco plant grown under comparable conditions. In an aspect, the fresh weight biomass of suckers of a tobacco plant provided herein is reduced by between 5% and 100% as compared to the fresh weight biomass of suckers of a control tobacco plant grown under comparable conditions. In an aspect, the fresh weight biomass of suckers of a tobacco plant provided herein is reduced by between 10% and 25% as compared to the fresh weight biomass of suckers of a control tobacco plant grown under comparable conditions. In an aspect, the fresh weight biomass of suckers of a tobacco plant provided herein is reduced by between 10% and 50% as compared to the fresh weight biomass of suckers of a control tobacco plant grown under comparable conditions. In an aspect, the fresh weight biomass of suckers of a tobacco plant provided herein is reduced by between 10% and 75% as compared to the fresh weight biomass of suckers of a control tobacco plant grown under comparable conditions. In an aspect, the fresh weight biomass of suckers of a tobacco plant provided herein is reduced by between 10% and 100% as compared to the fresh weight biomass of suckers of a control tobacco plant grown under comparable conditions. In an aspect, the fresh weight biomass of suckers of a tobacco plant provided herein is reduced by between 25% and 50% as compared to the fresh weight biomass of suckers of a control tobacco plant grown under comparable conditions. In an aspect, the fresh weight biomass of suckers of a tobacco plant provided herein is reduced by between 25% and 75% as compared to the fresh weight biomass of suckers of a control tobacco plant grown under comparable conditions. In an aspect, the fresh weight biomass of suckers of a tobacco plant provided herein is reduced by between 25% and 100% as compared to the fresh weight biomass of suckers of a control tobacco plant grown under comparable conditions. In an aspect, the fresh weight biomass of suckers of a tobacco plant provided herein is reduced by between 50% and 75% as compared to the fresh weight biomass of suckers of a control tobacco plant grown under comparable conditions. In an aspect, the fresh weight biomass of suckers of a tobacco plant provided herein is reduced by between 50% and 100% as compared to the fresh weight biomass of suckers of a control tobacco plant grown under comparable conditions. In an aspect, the fresh weight biomass of suckers of a tobacco plant provided herein is reduced by between 75% and 100% as compared to the fresh weight biomass of suckers of a control tobacco plant grown under comparable conditions.

In an aspect, the dry weight biomass of suckers of a tobacco plant provided herein is at least 10% reduced compared to the dry weight biomass of suckers of a control tobacco plant grown under comparable conditions. In another aspect, the dry weight biomass of suckers of a tobacco plant provided herein is at least 15% reduced compared to the dry weight biomass of suckers of a control tobacco plant grown under comparable conditions. In another aspect, the dry weight biomass of suckers of a tobacco plant provided herein is at least 20% reduced compared to the dry weight biomass of suckers of a control tobacco plant grown under comparable conditions. In another aspect, the dry weight biomass of suckers of a tobacco plant provided herein is at least 25% reduced compared to the dry weight biomass of suckers of a control tobacco plant grown under comparable conditions. In another aspect, the dry weight biomass of suckers of a tobacco plant provided herein is at least 30% reduced compared to the dry weight biomass of suckers of a control tobacco plant grown under comparable conditions. In another aspect, the dry weight biomass of suckers of a tobacco plant provided herein is at least 35% reduced compared to the dry weight biomass of suckers of a control tobacco plant grown under comparable conditions. In another aspect, the dry weight biomass of suckers of a tobacco plant provided herein is at least 40% reduced compared to the dry weight biomass of suckers of a control tobacco plant grown under comparable conditions. In another aspect, the dry weight biomass of suckers of a tobacco plant provided herein is at least 45% reduced compared to the dry weight biomass of suckers of a control tobacco plant grown under comparable conditions. In another aspect, the dry weight biomass of suckers of a tobacco plant provided herein is at least 50% reduced compared to the dry weight biomass of suckers of a control tobacco plant grown under comparable conditions. In another aspect, the dry weight biomass of suckers of a tobacco plant provided herein is at least 55% reduced compared to the dry weight biomass of suckers of a control tobacco plant grown under comparable conditions. In another aspect, the dry weight biomass of suckers of a tobacco plant provided herein is at least 60% reduced compared to the dry weight biomass of suckers of a control tobacco plant grown under comparable conditions. In another aspect, the dry weight biomass of suckers of a tobacco plant provided herein is at least 65% reduced compared to the dry weight biomass of suckers of a control tobacco plant grown under comparable conditions. In another aspect, the dry weight biomass of suckers of a tobacco plant provided herein is at least 70% reduced compared to the dry weight biomass of suckers of a control tobacco plant grown under comparable conditions. In another aspect, the dry weight biomass of suckers of a tobacco plant provided herein is at least 75% reduced compared to the dry weight biomass of suckers of a control tobacco plant grown under comparable conditions. In another aspect, the dry weight biomass of suckers of a tobacco plant provided herein is at least 80% reduced compared to the dry weight biomass of suckers of a control tobacco plant grown under comparable conditions. In another aspect, the dry weight biomass of suckers of a tobacco plant provided herein is at least 85% reduced compared to the dry weight biomass of suckers of a control tobacco plant grown under comparable conditions. In another aspect, the dry weight biomass of suckers of a tobacco plant provided herein is at least 90% reduced compared to the dry weight biomass of suckers of a control tobacco plant grown under comparable conditions. In another aspect, the dry weight biomass of suckers of a tobacco plant provided herein is at least 95% reduced compared to the dry weight biomass of suckers of a control tobacco plant grown under comparable conditions.

In an aspect, the dry weight biomass of suckers of a tobacco plant provided herein is reduced by between 1% and 25% as compared to the dry weight biomass of suckers of a control tobacco plant grown under comparable conditions. In an aspect, the dry weight biomass of suckers of a tobacco plant provided herein is reduced by between 1% and 50% as compared to the dry weight biomass of suckers of a control tobacco plant grown under comparable conditions. In an aspect, the dry weight biomass of suckers of a tobacco plant provided herein is reduced by between 1% and 75% as compared to the dry weight biomass of suckers of a control tobacco plant grown under comparable conditions. In an aspect, the dry weight biomass of suckers of a tobacco plant provided herein is reduced by between 1% and 100% as compared to the dry weight biomass of suckers of a control tobacco plant grown under comparable conditions. In an aspect, the dry weight biomass of suckers of a tobacco plant provided herein is reduced by between 5% and 25% as compared to the dry weight biomass of suckers of a control tobacco plant grown under comparable conditions. In an aspect, the dry weight biomass of suckers of a tobacco plant provided herein is reduced by between 5% and 50% as compared to the dry weight biomass of suckers of a control tobacco plant grown under comparable conditions. In an aspect, the dry weight biomass of suckers of a tobacco plant provided herein is reduced by between 5% and 75% as compared to the dry weight biomass of suckers of a control tobacco plant grown under comparable conditions. In an aspect, the dry weight biomass of suckers of a tobacco plant provided herein is reduced by between 5% and 100% as compared to the dry weight biomass of suckers of a control tobacco plant grown under comparable conditions. In an aspect, the dry weight biomass of suckers of a tobacco plant provided herein is reduced by between 10% and 25% as compared to the dry weight biomass of suckers of a control tobacco plant grown under comparable conditions. In an aspect, the dry weight biomass of suckers of a tobacco plant provided herein is reduced by between 10% and 50% as compared to the dry weight biomass of suckers of a control tobacco plant grown under comparable conditions. In an aspect, the dry weight biomass of suckers of a tobacco plant provided herein is reduced by between 10% and 75% as compared to the dry weight biomass of suckers of a control tobacco plant grown under comparable conditions. In an aspect, the dry weight biomass of suckers of a tobacco plant provided herein is reduced by between 10% and 100% as compared to the dry weight biomass of suckers of a control tobacco plant grown under comparable conditions. In an aspect, the dry weight biomass of suckers of a tobacco plant provided herein is reduced by between 25% and 50% as compared to the dry weight biomass of suckers of a control tobacco plant grown under comparable conditions. In an aspect, the dry weight biomass of suckers of a tobacco plant provided herein is reduced by between 25% and 75% as compared to the dry weight biomass of suckers of a control tobacco plant grown under comparable conditions. In an aspect, the dry weight biomass of suckers of a tobacco plant provided herein is reduced by between 25% and 100% as compared to the dry weight biomass of suckers of a control tobacco plant grown under comparable conditions. In an aspect, the dry weight biomass of suckers of a tobacco plant provided herein is reduced by between 50% and 75% as compared to the dry weight biomass of suckers of a control tobacco plant grown under comparable conditions. In an aspect, the dry weight biomass of suckers of a tobacco plant provided herein is reduced by between 50% and 100% as compared to the dry weight biomass of suckers of a control tobacco plant grown under comparable conditions. In an aspect, the dry weight biomass of suckers of a tobacco plant provided herein is reduced by between 75% and 100% as compared to the dry weight biomass of suckers of a control tobacco plant grown under comparable conditions.

In an aspect, the length of suckers of a tobacco plant provided herein is at least 10% reduced compared to the length of suckers of a control tobacco plant grown under comparable conditions. In another aspect, the length of suckers of a tobacco plant provided herein is at least 15% reduced compared to the length of suckers of a control tobacco plant grown under comparable conditions. In another aspect, the length of suckers of a tobacco plant provided herein is at least 20% reduced compared to the length of suckers of a control tobacco plant grown under comparable conditions. In another aspect, the length of suckers of a tobacco plant provided herein is at least 25% reduced compared to the length of suckers of a control tobacco plant grown under comparable conditions. In another aspect, the length of suckers of a tobacco plant provided herein is at least 30% reduced compared to the length of suckers of a control tobacco plant grown under comparable conditions. In another aspect, the length of suckers of a tobacco plant provided herein is at least 35% reduced compared to the length of suckers of a control tobacco plant grown under comparable conditions. In another aspect, the length of suckers of a tobacco plant provided herein is at least 40% reduced compared to the length of suckers of a control tobacco plant grown under comparable conditions. In another aspect, the length of suckers of a tobacco plant provided herein is at least 45% reduced compared to the length of suckers of a control tobacco plant grown under comparable conditions. In another aspect, the length of suckers of a tobacco plant provided herein is at least 50% reduced compared to the length of suckers of a control tobacco plant grown under comparable conditions. In another aspect, the length of suckers of a tobacco plant provided herein is at least 55% reduced compared to the length of suckers of a control tobacco plant grown under comparable conditions. In another aspect, the length of suckers of a tobacco plant provided herein is at least 60% reduced compared to the length of suckers of a control tobacco plant grown under comparable conditions. In another aspect, the length of suckers of a tobacco plant provided herein is at least 65% reduced compared to the length of suckers of a control tobacco plant grown under comparable conditions. In another aspect, the length of suckers of a tobacco plant provided herein is at least 70% reduced compared to the length of suckers of a control tobacco plant grown under comparable conditions. In another aspect, the length of suckers of a tobacco plant provided herein is at least 75% reduced compared to the length of suckers of a control tobacco plant grown under comparable conditions. In another aspect, the length of suckers of a tobacco plant provided herein is at least 80% reduced compared to the length of suckers of a control tobacco plant grown under comparable conditions. In another aspect, the length of suckers of a tobacco plant provided herein is at least 85% reduced compared to the length of suckers of a control tobacco plant grown under comparable conditions. In another aspect, the length of suckers of a tobacco plant provided herein is at least 90% reduced compared to the length of suckers of a control tobacco plant grown under comparable conditions. In another aspect, the length of suckers of a tobacco plant provided herein is at least 95% reduced compared to the length of suckers of a control tobacco plant grown under comparable conditions.

In an aspect, the length of suckers of a tobacco plant provided herein is reduced by between 1% and 25% as compared to the length of suckers of a control tobacco plant grown under comparable conditions. In an aspect, the length of suckers of a tobacco plant provided herein is reduced by between 1% and 50% as compared to the length of suckers of a control tobacco plant grown under comparable conditions. In an aspect, the length of suckers of a tobacco plant provided herein is reduced by between 1% and 75% as compared to the length of suckers of a control tobacco plant grown under comparable conditions. In an aspect, the length of suckers of a tobacco plant provided herein is reduced by between 1% and 100% as compared to the length of suckers of a control tobacco plant grown under comparable conditions. In an aspect, the length of suckers of a tobacco plant provided herein is reduced by between 5% and 25% as compared to the length of suckers of a control tobacco plant grown under comparable conditions. In an aspect, the length of suckers of a tobacco plant provided herein is reduced by between 5% and 50% as compared to the length of suckers of a control tobacco plant grown under comparable conditions. In an aspect, the length of suckers of a tobacco plant provided herein is reduced by between 5% and 75% as compared to the length of suckers of a control tobacco plant grown under comparable conditions. In an aspect, the length of suckers of a tobacco plant provided herein is reduced by between 5% and 100% as compared to the length of suckers of a control tobacco plant grown under comparable conditions. In an aspect, the length of suckers of a tobacco plant provided herein is reduced by between 10% and 25% as compared to the length of suckers of a control tobacco plant grown under comparable conditions. In an aspect, the length of suckers of a tobacco plant provided herein is reduced by between 10% and 50% as compared to the length of suckers of a control tobacco plant grown under comparable conditions. In an aspect, the length of suckers of a tobacco plant provided herein is reduced by between 10% and 75% as compared to the length of suckers of a control tobacco plant grown under comparable conditions. In an aspect, the length of suckers of a tobacco plant provided herein is reduced by between 10% and 100% as compared to the length of suckers of a control tobacco plant grown under comparable conditions. In an aspect, the length of suckers of a tobacco plant provided herein is reduced by between 25% and 50% as compared to the length of suckers of a control tobacco plant grown under comparable conditions. In an aspect, the length of suckers of a tobacco plant provided herein is reduced by between 25% and 75% as compared to the length of suckers of a control tobacco plant grown under comparable conditions. In an aspect, the length of suckers of a tobacco plant provided herein is reduced by between 25% and 100% as compared to the length of suckers of a control tobacco plant grown under comparable conditions. In an aspect, the length of suckers of a tobacco plant provided herein is reduced by between 50% and 75% as compared to the length of suckers of a control tobacco plant grown under comparable conditions. In an aspect, the length of suckers of a tobacco plant provided herein is reduced by between 50% and 100% as compared to the length of suckers of a control tobacco plant grown under comparable conditions. In an aspect, the length of suckers of a tobacco plant provided herein is reduced by between 75% and 100% as compared to the length of suckers of a control tobacco plant grown under comparable conditions.

In an aspect, the diameter of suckers of a tobacco plant provided herein is at least 10% reduced compared to the diameter of suckers of a control tobacco plant grown under comparable conditions. In another aspect, the diameter of suckers of a tobacco plant provided herein is at least 15% reduced compared to the diameter of suckers of a control tobacco plant grown under comparable conditions. In another aspect, the diameter of suckers of a tobacco plant provided herein is at least 20% reduced compared to the diameter of suckers of a control tobacco plant grown under comparable conditions. In another aspect, the diameter of suckers of a tobacco plant provided herein is at least 25% reduced compared to the diameter of suckers of a control tobacco plant grown under comparable conditions. In another aspect, the diameter of suckers of a tobacco plant provided herein is at least 30% reduced compared to the diameter of suckers of a control tobacco plant grown under comparable conditions. In another aspect, the diameter of suckers of a tobacco plant provided herein is at least 35% reduced compared to the diameter of suckers of a control tobacco plant grown under comparable conditions. In another aspect, the diameter of suckers of a tobacco plant provided herein is at least 40% reduced compared to the diameter of suckers of a control tobacco plant grown under comparable conditions. In another aspect, the diameter of suckers of a tobacco plant provided herein is at least 45% reduced compared to the diameter of suckers of a control tobacco plant grown under comparable conditions. In another aspect, the diameter of suckers of a tobacco plant provided herein is at least 50% reduced compared to the diameter of suckers of a control tobacco plant grown under comparable conditions. In another aspect, the diameter of suckers of a tobacco plant provided herein is at least 55% reduced compared to the diameter of suckers of a control tobacco plant grown under comparable conditions. In another aspect, the diameter of suckers of a tobacco plant provided herein is at least 60% reduced compared to the diameter of suckers of a control tobacco plant grown under comparable conditions. In another aspect, the diameter of suckers of a tobacco plant provided herein is at least 65% reduced compared to the diameter of suckers of a control tobacco plant grown under comparable conditions. In another aspect, the diameter of suckers of a tobacco plant provided herein is at least 70% reduced compared to the diameter of suckers of a control tobacco plant grown under comparable conditions. In another aspect, the diameter of suckers of a tobacco plant provided herein is at least 75% reduced compared to the diameter of suckers of a control tobacco plant grown under comparable conditions. In another aspect, the diameter of suckers of a tobacco plant provided herein is at least 80% reduced compared to the diameter of suckers of a control tobacco plant grown under comparable conditions. In another aspect, the diameter of suckers of a tobacco plant provided herein is at least 85% reduced compared to the diameter of suckers of a control tobacco plant grown under comparable conditions. In another aspect, the diameter of suckers of a tobacco plant provided herein is at least 90% reduced compared to the diameter of suckers of a control tobacco plant grown under comparable conditions. In another aspect, the diameter of suckers of a tobacco plant provided herein is at least 95% reduced compared to the diameter of suckers of a control tobacco plant grown under comparable conditions.

In an aspect, the diameter of suckers of a tobacco plant provided herein is reduced by between 1% and 25% as compared to the diameter of suckers of a control tobacco plant grown under comparable conditions. In an aspect, the diameter of suckers of a tobacco plant provided herein is reduced by between 1% and 50% as compared to the diameter of suckers of a control tobacco plant grown under comparable conditions. In an aspect, the diameter of suckers of a tobacco plant provided herein is reduced by between 1% and 75% as compared to the diameter of suckers of a control tobacco plant grown under comparable conditions. In an aspect, the diameter of suckers of a tobacco plant provided herein is reduced by between 1% and 100% as compared to the diameter of suckers of a control tobacco plant grown under comparable conditions. In an aspect, the diameter of suckers of a tobacco plant provided herein is reduced by between 5% and 25% as compared to the diameter of suckers of a control tobacco plant grown under comparable conditions. In an aspect, the diameter of suckers of a tobacco plant provided herein is reduced by between 5% and 50% as compared to the diameter of suckers of a control tobacco plant grown under comparable conditions. In an aspect, the diameter of suckers of a tobacco plant provided herein is reduced by between 5% and 75% as compared to the diameter of suckers of a control tobacco plant grown under comparable conditions. In an aspect, the diameter of suckers of a tobacco plant provided herein is reduced by between 5% and 100% as compared to the diameter of suckers of a control tobacco plant grown under comparable conditions. In an aspect, the diameter of suckers of a tobacco plant provided herein is reduced by between 10% and 25% as compared to the diameter of suckers of a control tobacco plant grown under comparable conditions. In an aspect, the diameter of suckers of a tobacco plant provided herein is reduced by between 10% and 50% as compared to the diameter of suckers of a control tobacco plant grown under comparable conditions. In an aspect, the diameter of suckers of a tobacco plant provided herein is reduced by between 10% and 75% as compared to the diameter of suckers of a control tobacco plant grown under comparable conditions. In an aspect, the diameter of suckers of a tobacco plant provided herein is reduced by between 10% and 100% as compared to the diameter of suckers of a control tobacco plant grown under comparable conditions. In an aspect, the diameter of suckers of a tobacco plant provided herein is reduced by between 25% and 50% as compared to the diameter of suckers of a control tobacco plant grown under comparable conditions. In an aspect, the diameter of suckers of a tobacco plant provided herein is reduced by between 25% and 75% as compared to the diameter of suckers of a control tobacco plant grown under comparable conditions. In an aspect, the diameter of suckers of a tobacco plant provided herein is reduced by between 25% and 100% as compared to the diameter of suckers of a control tobacco plant grown under comparable conditions. In an aspect, the diameter of suckers of a tobacco plant provided herein is reduced by between 50% and 75% as compared to the diameter of suckers of a control tobacco plant grown under comparable conditions. In an aspect, the diameter of suckers of a tobacco plant provided herein is reduced by between 50% and 100% as compared to the diameter of suckers of a control tobacco plant grown under comparable conditions. In an aspect, the diameter of suckers of a tobacco plant provided herein is reduced by between 75% and 100% as compared to the diameter of suckers of a control tobacco plant grown under comparable conditions.

In an aspect, a tobacco plant provided herein comprises at least 1 fewer total suckers compared to a control tobacco plant grown under comparable conditions. In an aspect, a tobacco plant provided herein comprises at least 2 fewer total suckers compared to a control tobacco plant grown under comparable conditions. In an aspect, a tobacco plant provided herein comprises at least 3 fewer total suckers compared to a control tobacco plant grown under comparable conditions. In an aspect, a tobacco plant provided herein comprises at least 4 fewer total suckers compared to a control tobacco plant grown under comparable conditions. In an aspect, a tobacco plant provided herein comprises at least 5 fewer total suckers compared to a control tobacco plant grown under comparable conditions. In an aspect, a tobacco plant provided herein comprises at least 6 fewer total suckers compared to a control tobacco plant grown under comparable conditions. In an aspect, a tobacco plant provided herein comprises at least 7 fewer total suckers compared to a control tobacco plant grown under comparable conditions. In an aspect, a tobacco plant provided herein comprises at least 8 fewer total suckers compared to a control tobacco plant grown under comparable conditions. In an aspect, a tobacco plant provided herein comprises at least 9 fewer total suckers compared to a control tobacco plant grown under comparable conditions. In an aspect, a tobacco plant provided herein comprises at least 10 fewer total suckers compared to a control tobacco plant grown under comparable conditions. In an aspect, a tobacco plant provided herein comprises at least 15 fewer total suckers compared to a control tobacco plant grown under comparable conditions. In an aspect, a tobacco plant provided herein comprises at least 20 fewer total suckers compared to a control tobacco plant grown under comparable conditions. In an aspect, a tobacco plant provided herein comprises at least 30 fewer total suckers compared to a control tobacco plant grown under comparable conditions. In an aspect, a tobacco plant provided herein comprises at least 40 fewer total suckers compared to a control tobacco plant grown under comparable conditions. In an aspect, a tobacco plant provided herein comprises at least 50 fewer total suckers compared to a control tobacco plant grown under comparable conditions. In an aspect, a tobacco plant provided herein comprises at least 60 fewer total suckers compared to a control tobacco plant grown under comparable conditions.

In an aspect, a tobacco plant provided herein comprises at least 10% fewer suckers compared to a control tobacco plant grown under comparable conditions. In an aspect, a tobacco plant provided herein comprises at least 15% fewer suckers compared to a control tobacco plant grown under comparable conditions. In an aspect, a tobacco plant provided herein comprises at least 20% fewer suckers compared to a control tobacco plant grown under comparable conditions. In an aspect, a tobacco plant provided herein comprises at least 25% fewer suckers compared to a control tobacco plant grown under comparable conditions. In an aspect, a tobacco plant provided herein comprises at least 30% fewer suckers compared to a control tobacco plant grown under comparable conditions. In an aspect, a tobacco plant provided herein comprises at least 35% fewer suckers compared to a control tobacco plant grown under comparable conditions. In an aspect, a tobacco plant provided herein comprises at least 40% fewer suckers compared to a control tobacco plant grown under comparable conditions. In an aspect, a tobacco plant provided herein comprises at least 45% fewer suckers compared to a control tobacco plant grown under comparable conditions. In an aspect, a tobacco plant provided herein comprises at least 50% fewer suckers compared to a control tobacco plant grown under comparable conditions. In an aspect, a tobacco plant provided herein comprises at least 55% fewer suckers compared to a control tobacco plant grown under comparable conditions. In an aspect, a tobacco plant provided herein comprises at least 60% fewer suckers compared to a control tobacco plant grown under comparable conditions. In an aspect, a tobacco plant provided herein comprises at least 65% fewer suckers compared to a control tobacco plant grown under comparable conditions. In an aspect, a tobacco plant provided herein comprises at least 70% fewer suckers compared to a control tobacco plant grown under comparable conditions. In an aspect, a tobacco plant provided herein comprises at least 75% fewer suckers compared to a control tobacco plant grown under comparable conditions. In an aspect, a tobacco plant provided herein comprises at least 80% fewer suckers compared to a control tobacco plant grown under comparable conditions. In an aspect, a tobacco plant provided herein comprises at least 85% fewer suckers compared to a control tobacco plant grown under comparable conditions. In an aspect, a tobacco plant provided herein comprises at least 90% fewer suckers compared to a control tobacco plant grown under comparable conditions. In an aspect, a tobacco plant provided herein comprises at least 95% fewer suckers compared to a control tobacco plant grown under comparable conditions.

In an aspect, a tobacco plant provided herein comprises between 1% and 25% fewer suckers compared to a control tobacco plant grown under comparable conditions. In an aspect, a tobacco plant provided herein comprises between 1% and 50% fewer suckers compared to a control tobacco plant grown under comparable conditions. In an aspect, a tobacco plant provided herein comprises between 1% and 75% fewer suckers compared to a control tobacco plant grown under comparable conditions. In an aspect, a tobacco plant provided herein comprises between 1% and 100% fewer suckers compared to a control tobacco plant grown under comparable conditions. In an aspect, a tobacco plant provided herein comprises between 5% and 25% fewer suckers compared to a control tobacco plant grown under comparable conditions. In an aspect, a tobacco plant provided herein comprises between 5% and 50% fewer suckers compared to a control tobacco plant grown under comparable conditions. In an aspect, a tobacco plant provided herein comprises between 5% and 75% fewer suckers compared to a control tobacco plant grown under comparable conditions. In an aspect, a tobacco plant provided herein comprises between 5% and 100% fewer suckers compared to a control tobacco plant grown under comparable conditions. In an aspect, a tobacco plant provided herein comprises between 10% and 25% fewer suckers compared to a control tobacco plant grown under comparable conditions. In an aspect, a tobacco plant provided herein comprises between 10% and 50% fewer suckers compared to a control tobacco plant grown under comparable conditions. In an aspect, a tobacco plant provided herein comprises between 10% and 75% fewer suckers compared to a control tobacco plant grown under comparable conditions. In an aspect, a tobacco plant provided herein comprises between 10% and 100% fewer suckers compared to a control tobacco plant grown under comparable conditions. In an aspect, a tobacco plant provided herein comprises between 25% and 50% fewer suckers compared to a control tobacco plant grown under comparable conditions. In an aspect, a tobacco plant provided herein comprises between 25% and 75% fewer suckers compared to a control tobacco plant grown under comparable conditions. In an aspect, a tobacco plant provided herein comprises between 25% and 100% fewer suckers compared to a control tobacco plant grown under comparable conditions. In an aspect, a tobacco plant provided herein comprises between 50% and 75% fewer suckers compared to a control tobacco plant grown under comparable conditions. In an aspect, a tobacco plant provided herein comprises between 50% and 100% fewer suckers compared to a control tobacco plant grown under comparable conditions. In an aspect, a tobacco plant provided herein comprises between 75% and 100% fewer suckers compared to a control tobacco plant grown under comparable conditions.

In one aspect, a tobacco plant provided herein comprises a similar or higher leaf yield mass compared to a control tobacco plant when grown under comparable conditions. As used herein, "similar" refers to within 10%. In an aspect, leaf yield mass is selected from the group consisting of fresh yield mass, dry yield mass, and cured yield mass. In another aspect, a tobacco plant provided herein comprises a higher leaf yield mass as compared to a control tobacco plant. In an aspect, a tobacco plant provided herein produces a leaf yield mass within 50% of the leaf yield mass of a control tobacco plant when grown under comparable conditions. In an aspect, a tobacco plant provided herein produces a leaf yield mass within 45% of the leaf yield mass of a control tobacco plant when grown under comparable conditions. In an aspect, a tobacco plant provided herein produces a leaf yield mass within 40% of the leaf yield mass of a control tobacco plant when grown under comparable conditions. In an aspect, a tobacco plant provided herein produces a leaf yield mass within 35% of the leaf yield mass of a control tobacco plant when grown under comparable conditions. In an aspect, a tobacco plant provided herein produces a leaf yield mass within 30% of the leaf yield mass of a control tobacco plant when grown under comparable conditions. In an aspect, a tobacco plant provided herein produces a leaf yield mass within 25% of the leaf yield mass of a control tobacco plant when grown under comparable conditions. In an aspect, a tobacco plant provided herein produces a leaf yield mass within 20% of the leaf yield mass of a control tobacco plant when grown under comparable conditions. In an aspect, a tobacco plant provided herein produces a leaf yield mass within 15% of the leaf yield mass of a control tobacco plant when grown under comparable conditions. In an aspect, a tobacco plant provided herein produces a leaf yield mass within 10% of the leaf yield mass of a control tobacco plant when grown under comparable conditions. In an aspect, a tobacco plant provided herein produces a leaf yield mass within 5% of the leaf yield mass of a control tobacco plant when grown under comparable conditions. In an aspect, a tobacco plant provided herein produces a leaf yield mass within 4% of the leaf yield mass of a control tobacco plant when grown under comparable conditions. In an aspect, a tobacco plant provided herein produces a leaf yield mass within 3% of the leaf yield mass of a control tobacco plant when grown under comparable conditions. In an aspect, a tobacco plant provided herein produces a leaf yield mass within 2% of the leaf yield mass of a control tobacco plant when grown under comparable conditions. In an aspect, a tobacco plant provided herein produces a leaf yield mass within 1% of the leaf yield mass of a control tobacco plant when grown under comparable conditions. In an aspect, a tobacco plant provided herein produces a leaf yield mass within 0.5% of the leaf yield mass of a control tobacco plant when grown under comparable conditions.

In an aspect, a tobacco plant provided herein produces a dry leaf mass at least 0.25% more than the dry leaf mass of a control tobacco plant when grown under comparable conditions. In an aspect, a tobacco plant provided herein produces a dry leaf mass at least 0.5% more than the dry leaf mass of a control tobacco plant when grown under comparable conditions. In an aspect, a tobacco plant provided herein produces a dry leaf mass at least 1% more than the dry leaf mass of a control tobacco plant when grown under comparable conditions. In an aspect, a tobacco plant provided herein produces a dry leaf mass at least 2.5% more than the dry leaf mass of a control tobacco plant when grown under comparable conditions. In an aspect, a tobacco plant provided herein produces a dry leaf mass at least 5% more than the dry leaf mass of a control tobacco plant when grown under comparable conditions. In an aspect, a tobacco plant provided herein produces a dry leaf mass at least 10% more than the dry leaf mass of a control tobacco plant when grown under comparable conditions. In an aspect, a tobacco plant provided herein produces a dry leaf mass at least 15% more than the dry leaf mass of a control tobacco plant when grown under comparable conditions. In an aspect, a tobacco plant provided herein produces a dry leaf mass at least 20% more than the dry leaf mass of a control tobacco plant when grown under comparable conditions. In an aspect, a tobacco plant provided herein produces a dry leaf mass at least 25% more than the dry leaf mass of a control tobacco plant when grown under comparable conditions. In an aspect, a tobacco plant provided herein produces a dry leaf mass at least 30% more than the dry leaf mass of a control tobacco plant when grown under comparable conditions. In an aspect, a tobacco plant provided herein produces a dry leaf mass at least 40% more than the dry leaf mass of a control tobacco plant when grown under comparable conditions. In an aspect, a tobacco plant provided herein produces a dry leaf mass at least 50% more than the dry leaf mass of a control tobacco plant when grown under comparable conditions. In an aspect, a tobacco plant provided herein produces a dry leaf mass at least 60% more than the dry leaf mass of a control tobacco plant when grown under comparable conditions. In an aspect, a tobacco plant provided herein produces a dry leaf mass at least 70% more than the dry leaf mass of a control tobacco plant when grown under comparable conditions. In an aspect, a tobacco plant provided herein produces a dry leaf mass at least 80% more than the dry leaf mass of a control tobacco plant when grown under comparable conditions. In an aspect, a tobacco plant provided herein produces a dry leaf mass at least 90% more than the dry leaf mass of a control tobacco plant when grown under comparable conditions. In an aspect, a tobacco plant provided herein produces a dry leaf mass at least 100% more than the dry leaf mass of a control tobacco plant when grown under comparable conditions. In an aspect, a tobacco plant provided herein produces a dry leaf mass at least 150% more than the dry leaf mass of a control tobacco plant when grown under comparable conditions.

In an aspect, a tobacco plant provided herein produces a dry leaf mass between 0.25% and 150% of the dry leaf mass of a control tobacco plant when grown under comparable conditions. In an aspect, a tobacco plant provided herein produces a dry leaf mass between 0.5% and 150% of the dry leaf mass of a control tobacco plant when grown under comparable conditions. In an aspect, a tobacco plant provided herein produces a dry leaf mass between 1% and 150% of the dry leaf mass of a control tobacco plant when grown under comparable conditions. In an aspect, a tobacco plant provided herein produces a dry leaf mass between 2.5% and 150% of the dry leaf mass of a control tobacco plant when grown under comparable conditions. In an aspect, a tobacco plant provided herein produces a dry leaf mass between 5% and 150% of the dry leaf mass of a control tobacco plant when grown under comparable conditions. In an aspect, a tobacco plant provided herein produces a dry leaf mass between 10% and 150% of the dry leaf mass of a control tobacco plant when grown under comparable conditions. In an aspect, a tobacco plant provided herein produces a dry leaf mass between 15% and 150% of the dry leaf mass of a control tobacco plant when grown under comparable conditions. In an aspect, a tobacco plant provided herein produces a dry leaf mass between 20% and 150% of the dry leaf mass of a control tobacco plant when grown under comparable conditions. In an aspect, a tobacco plant provided herein produces a dry leaf mass between 25% and 150% of the dry leaf mass of a control tobacco plant when grown under comparable conditions. In an aspect, a tobacco plant provided herein produces a dry leaf mass between 30% and 150% of the dry leaf mass of a control tobacco plant when grown under comparable conditions. In an aspect, a tobacco plant provided herein produces a dry leaf mass between 40% and 150% of the dry leaf mass of a control tobacco plant when grown under comparable conditions. In an aspect, a tobacco plant provided herein produces a dry leaf mass between 50% and 150% of the dry leaf mass of a control tobacco plant when grown under comparable conditions. In an aspect, a tobacco plant provided herein produces a dry leaf mass between 60% and 150% of the dry leaf mass of a control tobacco plant when grown under comparable conditions. In an aspect, a tobacco plant provided herein produces a dry leaf mass between 70% and 150% of the dry leaf mass of a control tobacco plant when grown under comparable conditions. In an aspect, a tobacco plant provided herein produces a dry leaf mass between 80% and 150% of the dry leaf mass of a control tobacco plant when grown under comparable conditions. In an aspect, a tobacco plant provided herein produces a dry leaf mass between 90% and 150% of the dry leaf mass of a control tobacco plant when grown under comparable conditions. In an aspect, a tobacco plant provided herein produces a dry leaf mass between 100% and 150% of the dry leaf mass of a control tobacco plant when grown under comparable conditions.

In an aspect, a tobacco plant provided herein produces a number of leaves within 75% of the number of leaves produced by a control tobacco plant grown under comparable conditions. In an aspect, a tobacco plant provided herein produces a number of leaves within 60% of the number of leaves produced by a control tobacco plant grown under comparable conditions. In an aspect, a tobacco plant provided herein produces a number of leaves within 50% of the number of leaves produced by a control tobacco plant grown under comparable conditions. In an aspect, a tobacco plant provided herein produces a number of leaves within 25% of the number of leaves produced by a control tobacco plant grown under comparable conditions. In an aspect, a tobacco plant provided herein produces a number of leaves within 15% of the number of leaves produced by a control tobacco plant grown under comparable conditions. In an aspect, a tobacco plant provided herein produces a number of leaves within 10% of the number of leaves produced by a control tobacco plant grown under comparable conditions. In an aspect, a tobacco plant provided herein produces a number of leaves within 5% of the number of leaves produced by a control tobacco plant grown under comparable conditions. In an aspect, a tobacco plant provided herein produces a number of leaves within 1% of the number of leaves produced by a control tobacco plant grown under comparable conditions.

In one aspect, a tobacco plant provided herein comprises a similar plant height compared to a control tobacco plant when grown under comparable conditions. In an aspect, plant height is measured as the distance between the uppermost surface of the growth media (e.g., soil) in which the plant is growing and the uppermost surface of the uppermost leaf of the plant. In an aspect, a tobacco plant comprises a height that is equal to or greater than the height of a control plant. In an aspect, a tobacco plant provided herein comprises a height at least 75% greater than the height of a control tobacco plant when grown under comparable conditions. In an aspect, a tobacco plant provided herein comprises a height at least 50% greater than the height of a control tobacco plant when grown under comparable conditions. In an aspect, a tobacco plant provided herein comprises a height at least 25% greater than the height of a control tobacco plant when grown under comparable conditions. In an aspect, a tobacco plant provided herein comprises a height at least 20% greater than the height of a control tobacco plant when grown under comparable conditions. In an aspect, a tobacco plant provided herein comprises a height at least 15% greater than the height of a control tobacco plant when grown under comparable conditions. In an aspect, a tobacco plant provided herein comprises a height at least 10% greater than the height of a control tobacco plant when grown under comparable conditions. In an aspect, a tobacco plant provided herein comprises a height at least 5% greater than the height of a control tobacco plant when grown under comparable conditions. In an aspect, a tobacco plant provided herein comprises a height at least 2.5% greater than the height of a control tobacco plant when grown under comparable conditions. In an aspect, a tobacco plant provided herein comprises a height at least 1% greater than the height of a control tobacco plant when grown under comparable conditions. In an aspect, a tobacco plant provided herein comprises a height at least 0.75% greater than the height of a control tobacco plant when grown under comparable conditions. In an aspect, a tobacco plant provided herein comprises a height at least 0.5% greater than the height of a control tobacco plant when grown under comparable conditions. In an aspect, a tobacco plant provided herein comprises a height at least 0.25% greater than the height of a control tobacco plant when grown under comparable conditions.

Tobacco grades are evaluated based on factors including, but not limited to, the leaf stalk position, leaf size, leaf color, leaf uniformity and integrity, ripeness, texture, elasticity, sheen (related with the intensity and the depth of coloration of the leaf as well as the shine), hygroscopicity (the faculty of the tobacco leaves to absorb and to retain the ambient moisture), and green nuance or cast. Leaf grade can be determined, for example, using an Official Standard Grade published by the Agricultural Marketing Service of the US Department of Agriculture (7 U.S.C. § 511). See, e.g., Official Standard Grades for Burley Tobacco (U.S. Type 31 and Foreign Type 93), effective Nov. 5, 1990 (55 F.R. 40645); Official Standard Grades for Flue-Cured Tobacco (U.S. Types 11, 12, 13, 14 and Foreign Type 92), effective Mar. 27, 1989 (54 F.R. 7925); Official Standard Grades for Pennsylvania Seedleaf Tobacco (U.S. Type 41), effective Jan. 8, 1965 (29 F.R. 16854); Official Standard Grades for Ohio Cigar-Leaf Tobacco (U.S. Types 42, 43, and 44), effective Dec. 8, 1963 (28 F.R. 11719 and 28 F.R. 11926); Official Standard Grades for Wisconsin Cigar-Binder Tobacco (U.S. Types 54 and 55), effective Nov. 20, 1969 (34 F.R. 17061); Official Standard Grades for Wisconsin Cigar-Binder Tobacco (U.S. Types 54 and 55), effective Nov. 20, 1969 (34 F.R. 17061); Official Standard Grades for Georgia and Florida Shade-Grown Cigar-Wrapper Tobacco (U.S. Type 62), Effective April 1971. A USDA grade index value can be determined according to an industry accepted grade index. See, e.g., Bowman et al, *Tobacco Science,* 32:39-40 (1988); Legacy Tobacco Document Library (Bates Document #523267826-523267833, Jul. 1, 1988, Memorandum on the Proposed Burley Tobacco Grade Index); and Miller et al., 1990, *Tobacco Intern.,* 192:55-57 (all foregoing references are incorporated by inference in their entirety). Alternatively, leaf grade can be determined via hyper-spectral imaging. See e.g., WO 2011/027315 (published on Mar. 10, 2011, and incorporated by inference in its entirety).

In one aspect, a tobacco plant provided herein produces leaves that have a similar or higher USDA grade index value compared to a control tobacco plant when grown under comparable conditions. In one aspect, a tobacco plant provided herein produces leaves with a USDA grade index value within about 50% of the USDA grade index value of a control tobacco plant when grown under comparable conditions. In one aspect, a tobacco plant provided herein produces leaves with a USDA grade index value within about 45% of the USDA grade index value of a control tobacco plant when grown under comparable conditions. In one aspect, a tobacco plant provided herein produces leaves with a USDA grade index value within about 40% of the USDA grade index value of a control tobacco plant when grown under comparable conditions. In one aspect, a tobacco plant provided herein produces leaves with a USDA grade index value within about 35% of the USDA grade index value of a control tobacco plant when grown under comparable conditions. In one aspect, a tobacco plant provided herein produces leaves with a USDA grade index value within about 30% of the USDA grade index value of a control tobacco plant when grown under comparable conditions. In one aspect, a tobacco plant provided herein produces leaves with a USDA grade index value within about 25% of the USDA grade index value of a control tobacco plant when grown under comparable conditions. In one aspect, a tobacco plant provided herein produces leaves with a USDA grade index value within about 20% of the USDA grade index value of a control tobacco plant when grown under comparable conditions. In one aspect, a tobacco plant provided herein produces leaves with a USDA grade index value within about 15% of the USDA grade index value of a control tobacco plant when grown under comparable conditions. In one aspect, a tobacco plant provided herein produces leaves with a USDA grade index value within about 10% of the USDA grade index value of a control tobacco plant when grown under comparable conditions. In one aspect, a tobacco plant provided herein produces leaves with a USDA grade index value within about 5% of the USDA grade index value of a control tobacco plant when grown under comparable conditions. In one aspect, a tobacco plant provided herein produces leaves with a USDA grade index value within about 4% of the USDA grade index value of a control tobacco plant when grown under comparable conditions. In one aspect, a tobacco plant provided herein produces leaves with a USDA grade index value within about 3% of the USDA grade index value of a control tobacco plant when grown under comparable conditions. In one aspect, a tobacco plant provided herein produces leaves with a USDA grade index value within about 2% of the USDA grade index value of a control tobacco plant when grown under comparable conditions. In one aspect, a tobacco plant provided herein produces leaves with a USDA grade index value within about 1% of the USDA grade index value of a control tobacco plant when grown under comparable conditions. In one aspect, a tobacco plant provided herein produces leaves with a USDA grade index value within about 0.5% of the USDA grade index value of a control tobacco plant when grown under comparable conditions.

In one aspect, a plant provided herein requires reduced management for controlling suckering compared to a control plant when grown under comparable conditions. As used herein, "management" refers to manually removing suckers, application of chemicals (e.g., maleic hydrazide, flumetralin) to inhibit or remove suckers, or both. In one aspect, a plant provided herein requires reduced frequency of manual sucker removal, reduced frequency of chemical application, reduced quantities of chemical application, or a combination thereof, compared to a control plant grown under comparable conditions. See, for example, Fisher et al. "Topping, Managing Suckers, and Using Ethephon," pages 96-117 In: 2016 Flue-Cured Tobacco Information, North Carolina State University, which is herein incorporated by reference in its entirety.

In one aspect, a plant or leaf provided herein has a similar leaf chemistry profile compared to a control plant when grown under comparable conditions. Without being limiting, a leaf chemistry profile can comprise the amount of alkaloids (e.g., nicotine, nornicotine, anabasine, anatabine), malic acid, and reducing sugars (e.g., dextrose), or a combination thereof in a tobacco plant or tobacco leaf. Without being limiting, leaf chemistry can be measured as milligrams per gram of dry leaf mass or as a percent of total dry leaf mass.

In an aspect, a plant or leaf provided herein comprises a total alkaloids level within 50% of the total alkaloids level of a control plant when grown under comparable conditions. In another aspect, a plant or leaf provided herein comprises a total alkaloids level within 40% of the total alkaloids level of a control plant when grown under comparable conditions. In another aspect, a plant or leaf provided herein comprises a total alkaloids level within 30% of the total alkaloids level of a control plant when grown under comparable conditions. In another aspect, a plant or leaf provided herein comprises a total alkaloids level within 25% of the total alkaloids level of a control plant when grown under comparable conditions. In another aspect, a plant or leaf provided herein comprises a total alkaloids level within 20% of the total alkaloids level of a control plant when grown under comparable conditions. In another aspect, a plant or leaf provided herein comprises a total alkaloids level within 15% of the total alkaloids level of a control plant when grown under comparable conditions. In another aspect, a plant or leaf provided herein comprises a total alkaloids level within 10% of the total alkaloids level of a control plant when grown under comparable conditions. In another aspect, a plant or leaf provided herein comprises a total alkaloids level within 5% of the total alkaloids level of a control plant when grown under comparable conditions. In another aspect, a plant or leaf provided herein comprises a total alkaloids level within 4% of the total alkaloids level of a control plant when grown under comparable conditions. In another aspect, a plant or leaf provided herein comprises a total alkaloids level within 3% of the total alkaloids level of a control plant when grown under comparable conditions. In another aspect, a plant or leaf provided herein comprises a total alkaloids level within 2% of the total alkaloids level of a control plant when grown under comparable conditions. In another aspect, a plant or leaf provided herein comprises a total alkaloids level within 1% of the total alkaloids level of a control plant when grown under comparable conditions. In another aspect, a plant or leaf provided herein comprises a total alkaloids level within 0.5% of the total alkaloids level of a control plant when grown under comparable conditions.

In an aspect, a plant or leaf provided herein comprises a nicotine level within 50% of the nicotine level of a control plant when grown under comparable conditions. In another aspect, a plant or leaf provided herein comprises a nicotine level within 40% of the nicotine level of a control plant when grown under comparable conditions. In another aspect, a plant or leaf provided herein comprises a nicotine level within 30% of the nicotine level of a control plant when grown under comparable conditions. In another aspect, a plant or leaf provided herein comprises a nicotine level within 25% of the nicotine level of a control plant when grown under comparable conditions. In another aspect, a plant or leaf provided herein comprises a nicotine level within 20% of the nicotine level of a control plant when grown under comparable conditions. In another aspect, a plant or leaf provided herein comprises a nicotine level within 15% of the nicotine level of a control plant when grown under comparable conditions. In another aspect, a plant or leaf provided herein comprises a nicotine level within 10% of the nicotine level of a control plant when grown under comparable conditions. In another aspect, a plant or leaf provided herein comprises a nicotine level within 5% of the nicotine level of a control plant when grown under comparable conditions. In another aspect, a plant or leaf provided herein comprises a nicotine level within 4% of the nicotine level of a control plant when grown under comparable conditions. In another aspect, a plant or leaf provided herein comprises a nicotine level within 3% of the nicotine level of a control plant when grown under comparable conditions. In another aspect, a plant or leaf provided herein comprises a nicotine level within 2% of the nicotine level of a control plant when grown under comparable conditions. In another aspect, a plant or leaf provided herein comprises a nicotine level within 1% of the nicotine level of a control plant when grown under comparable conditions. In another aspect, a plant or leaf provided herein comprises a nicotine level within 0.5% of the nicotine level of a control plant when grown under comparable conditions.

In an aspect, a plant or leaf provided herein comprises a nornicotine level within 50% of the nornicotine level of a control plant when grown under comparable conditions. In another aspect, a plant or leaf provided herein comprises a nornicotine level within 40% of the nornicotine level of a control plant when grown under comparable conditions. In another aspect, a plant or leaf provided herein comprises a nornicotine level within 30% of the nornicotine level of a control plant when grown under comparable conditions. In another aspect, a plant or leaf provided herein comprises a nornicotine level within 25% of the nornicotine level of a control plant when grown under comparable conditions. In another aspect, a plant or leaf provided herein comprises a nornicotine level within 20% of the nornicotine level of a control plant when grown under comparable conditions. In another aspect, a plant or leaf provided herein comprises a nornicotine level within 15% of the nornicotine level of a control plant when grown under comparable conditions. In another aspect, a plant or leaf provided herein comprises a nornicotine level within 10% of the nornicotine level of a control plant when grown under comparable conditions. In another aspect, a plant or leaf provided herein comprises a nornicotine level within 5% of the nornicotine level of a control plant when grown under comparable conditions. In another aspect, a plant or leaf provided herein comprises a nornicotine level within 4% of the nornicotine level of a control plant when grown under comparable conditions. In another aspect, a plant or leaf provided herein comprises a nornicotine level within 3% of the nornicotine level of a control plant when grown under comparable conditions. In another aspect, a plant or leaf provided herein comprises a nornicotine level within 2% of the nornicotine level of a control plant when grown under comparable conditions. In another aspect, a plant or leaf provided herein comprises a nornicotine level within 1% of the nornicotine level of a control plant when grown under comparable conditions. In another aspect, a plant or leaf provided herein comprises a nornicotine level within 0.5% of the nornicotine level of a control plant when grown under comparable conditions.

In an aspect, a plant or leaf provided herein comprises an anabasine level within 50% of the anabasine level of a control plant when grown under comparable conditions. In another aspect, a plant or leaf provided herein comprises an anabasine level within 40% of the anabasine level of a control plant when grown under comparable conditions. In another aspect, a plant or leaf provided herein comprises an anabasine level within 30% of the anabasine level of a control plant when grown under comparable conditions. In another aspect, a plant or leaf provided herein comprises an anabasine level within 25% of the anabasine level of a control plant when grown under comparable conditions. In another aspect, a plant or leaf provided herein comprises an anabasine level within 20% of the anabasine level of a control plant when grown under comparable conditions. In another aspect, a plant or leaf provided herein comprises an anabasine level within 15% of the anabasine level of a control plant when grown under comparable conditions. In another aspect, a plant or leaf provided herein comprises an anabasine level within 10% of the anabasine level of a control plant when grown under comparable conditions. In another aspect, a plant or leaf provided herein comprises an anabasine level within 5% of the anabasine level of a control plant when grown under comparable conditions. In another aspect, a plant or leaf provided herein comprises an anabasine level within 4% of the anabasine level of a control plant when grown under comparable conditions. In another aspect, a plant or leaf provided herein comprises an anabasine level within 3% of the anabasine level of a control plant when grown under comparable conditions. In another aspect, a plant or leaf provided herein comprises an anabasine level within 2% of the anabasine level of a control plant when grown under comparable conditions. In another aspect, a plant or leaf provided herein comprises an anabasine level within 1% of the anabasine level of a control plant when grown under comparable conditions. In another aspect, a plant or leaf provided herein comprises an anabasine level within 0.5% of the anabasine level of a control plant when grown under comparable conditions.

In an aspect, a plant or leaf provided herein comprises an anatabine level within 50% of the anatabine level of a control plant when grown under comparable conditions. In another aspect, a plant or leaf provided herein comprises an anatabine level within 40% of the anatabine level of a control plant when grown under comparable conditions. In another aspect, a plant or leaf provided herein comprises an anatabine level within 30% of the anatabine level of a control plant when grown under comparable conditions. In another aspect, a plant or leaf provided herein comprises an anatabine level within 25% of the anatabine level of a control plant when grown under comparable conditions. In another aspect, a plant or leaf provided herein comprises an anatabine level within 20% of the anatabine level of a control plant when grown under comparable conditions. In another aspect, a plant or leaf provided herein comprises an anatabine level within 15% of the anatabine level of a control plant when grown under comparable conditions. In another aspect, a plant or leaf provided herein comprises an anatabine level within 10% of the anatabine level of a control plant when grown under comparable conditions. In another aspect, a plant or leaf provided herein comprises an anatabine level within 5% of the anatabine level of a control plant when grown under comparable conditions. In another aspect, a plant or leaf provided herein comprises an anatabine level within 4% of the anatabine level of a control plant when grown under comparable conditions. In another aspect, a plant or leaf provided herein comprises an anatabine level within 3% of the anatabine level of a control plant when grown under comparable conditions. In another aspect, a plant or leaf provided herein comprises an anatabine level within 2% of the anatabine level of a control plant when grown under comparable conditions. In another aspect, a plant or leaf provided herein comprises an anatabine level within 1% of the anatabine level of a control plant when grown under comparable conditions. In another aspect, a plant or leaf provided herein comprises an anatabine level within 0.5% of the anatabine level of a control plant when grown under comparable conditions.

In an aspect, a plant or leaf provided herein comprises a malic acid level within 50% of the malic acid level of a control plant when grown under comparable conditions. In another aspect, a plant or leaf provided herein comprises a malic acid level within 40% of the malic acid level of a control plant when grown under comparable conditions. In another aspect, a plant or leaf provided herein comprises a malic acid level within 30% of the malic acid level of a control plant when grown under comparable conditions. In another aspect, a plant or leaf provided herein comprises a malic acid level within 25% of the malic acid level of a control plant when grown under comparable conditions. In another aspect, a plant or leaf provided herein comprises a malic acid level within 20% of the malic acid level of a control plant when grown under comparable conditions. In another aspect, a plant or leaf provided herein comprises a malic acid level within 15% of the malic acid level of a control plant when grown under comparable conditions. In another aspect, a plant or leaf provided herein comprises a malic acid level within 10% of the malic acid level of a control plant when grown under comparable conditions. In another aspect, a plant or leaf provided herein comprises a malic acid level within 5% of the malic acid level of a control plant when grown under comparable conditions. In another aspect, a plant or leaf provided herein comprises a malic acid level within 4% of the malic acid level of a control plant when grown under comparable conditions. In another aspect, a plant or leaf provided herein comprises a malic acid level within 3% of the malic acid level of a control plant when grown under comparable conditions. In another aspect, a plant or leaf provided herein comprises a malic acid level within 2% of the malic acid level of a control plant when grown under comparable conditions. In another aspect, a plant or leaf provided herein comprises a malic acid level within 1% of the malic acid level of a control plant when grown under comparable conditions. In another aspect, a plant or leaf provided herein comprises a malic acid level within 0.5% of the total malic acid level of a control plant when grown under comparable conditions.

In an aspect, a plant or leaf provided herein comprises a reducing sugars level within 50% of the reducing sugars level of a control plant when grown under comparable conditions. In another aspect, a plant or leaf provided herein comprises a reducing sugars level within 40% of the reducing sugars level of a control plant when grown under comparable conditions. In another aspect, a plant or leaf provided herein comprises a reducing sugars level within 30% of the reducing sugars level of a control plant when grown under comparable conditions. In another aspect, a plant or leaf provided herein comprises a reducing sugars level within 25% of the reducing sugars level of a control plant when grown under comparable conditions. In another aspect, a plant or leaf provided herein comprises a reducing sugars level within 20% of the reducing sugars level of a control plant when grown under comparable conditions. In another aspect, a plant or leaf provided herein comprises a reducing sugars level within 15% of the reducing sugars level of a control plant when grown under comparable conditions. In another aspect, a plant or leaf provided herein comprises a reducing sugars level within 10% of the reducing sugars level of a control plant when grown under comparable conditions. In another aspect, a plant or leaf provided herein comprises a reducing sugars level within 5% of the reducing sugars level of a control plant when grown under comparable conditions. In another aspect, a plant or leaf provided herein comprises a reducing sugars level within 4% of the reducing sugars level of a control plant when grown under comparable conditions. In another aspect, a plant or leaf provided herein comprises a reducing sugars level within 3% of the reducing sugars level of a control plant when grown under comparable conditions. In another aspect, a plant or leaf provided herein comprises a reducing sugars level within 2% of the reducing sugars level of a control plant when grown under comparable conditions. In another aspect, a plant or leaf provided herein comprises a reducing sugars level within 1% of the reducing sugars level of a control plant when grown under comparable conditions. In another aspect, a plant or leaf provided herein comprises a reducing sugars level within 0.5% of the reducing sugars level of a control plant when grown under comparable conditions.

In an aspect, a plant or leaf provided herein comprises a dextrose level within 50% of the dextrose level of a control plant when grown under comparable conditions. In another aspect, a plant or leaf provided herein comprises a dextrose level within 40% of the dextrose level of a control plant when grown under comparable conditions. In another aspect, a plant or leaf provided herein comprises a dextrose level within 30% of the dextrose level of a control plant when grown under comparable conditions. In another aspect, a plant or leaf provided herein comprises a dextrose level within 25% of the dextrose level of a control plant when grown under comparable conditions. In another aspect, a plant or leaf provided herein comprises a dextrose level within 20% of the dextrose level of a control plant when grown under comparable conditions. In another aspect, a plant or leaf provided herein comprises a dextrose level within 15% of the dextrose level of a control plant when grown under comparable conditions. In another aspect, a plant or leaf provided herein comprises a dextrose level within 10% of the dextrose level of a control plant when grown under comparable conditions. In another aspect, a plant or leaf provided herein comprises a dextrose level within 5% of the dextrose level of a control plant when grown under comparable conditions. In another aspect, a plant or leaf provided herein comprises a dextrose level within 4% of the dextrose level of a control plant when grown under comparable conditions. In another aspect, a plant or leaf provided herein comprises a dextrose level within 3% of the dextrose level of a control plant when grown under comparable conditions. In another aspect, a plant or leaf provided herein comprises a dextrose level within 2% of the dextrose level of a control plant when grown under comparable conditions. In another aspect, a plant or leaf provided herein comprises a dextrose level within 1% of the dextrose level of a control plant when grown under comparable conditions. In another aspect, a plant or leaf provided herein comprises a dextrose level within 0.5% of the dextrose level of a control plant when grown under comparable conditions.

In an aspect, a plant or leaf provided herein comprises no or reduced suckers compared to a control plant and further comprises a nicotine level at least 50% lower than the nicotine level of a control plant when grown under comparable conditions. In another aspect, a plant or leaf provided herein comprises no or reduced suckers compared to a control plant and further comprises a nicotine level at least 60% lower than the nicotine level of a control plant when grown under comparable conditions. In another aspect, a plant or leaf provided herein comprises no or reduced suckers compared to a control plant and further comprises a nicotine level at least 70% lower than the nicotine level of a control plant when grown under comparable conditions. In another aspect, a plant or leaf provided herein comprises no or reduced suckers compared to a control plant and further comprises a nicotine level at least 80% lower than the nicotine level of a control plant when grown under comparable conditions. In another aspect, a plant or leaf provided herein comprises no or reduced suckers compared to a control plant and further comprises a nicotine level at least 90% lower than the nicotine level of a control plant when grown under comparable conditions. In another aspect, a plant or leaf provided herein comprises no or reduced suckers compared to a control plant and further comprises a nicotine level at least 95% lower than the nicotine level of a control plant when grown under comparable conditions. In another aspect, a plant or leaf provided herein comprises no or reduced suckers compared to a control plant and further comprises a nicotine level at least 96% lower than the nicotine level of a control plant when grown under comparable conditions. In another aspect, a plant or leaf provided herein comprises no or reduced suckers compared to a control plant and further comprises a nicotine level at least 97% lower than the nicotine level of a control plant when grown under comparable conditions. In another aspect, a plant or leaf provided herein comprises no or reduced suckers compared to a control plant and further comprises a nicotine level at least 98% lower than the nicotine level of a control plant when grown under comparable conditions. In another aspect, a plant or leaf provided herein comprises no or reduced suckers compared to a control plant and further comprises a nicotine level at least 99% lower than the nicotine level of a control plant when grown under comparable conditions.

In one aspect, this disclosure provides tobacco leaves from any plant provided herein.

Tobacco material obtained from tobacco plants, cells, lines, varieties, or hybrids of the present disclosure can be used to make tobacco products. As used herein, "tobacco product" is defined as any product made or derived from tobacco that is intended for human use or consumption. In an aspect, a tobacco product provided herein comprises cured components from a tobacco plant provided herein. In another aspect, a tobacco product provided herein comprises cured tobacco leaves from a tobacco plant provided herein. In an aspect, this disclosure provides a tobacco product comprising cured tobacco material from any tobacco plant provided herein.

Alkaloid compounds can be extracted, or isolated, from any tobacco plant or plant part provided herein. In an aspect, a tobacco product provided herein comprises an alkaloid extracted from a tobacco plant or tobacco plant part. In another aspect, a tobacco product provided herein comprises nicotine extracted from a tobacco plant or tobacco plant part. In another aspect, a tobacco product provided herein comprises anatabine extracted from a tobacco plant or tobacco plant part. In another aspect, a tobacco product provided herein comprises anabasine extracted from a tobacco plant or tobacco plant part. In an aspect, a tobacco product provided herein comprises nornicotine extracted from a tobacco plant or plant part.

In an aspect, cured tobacco material provided herein comprises air-cured tobacco material. In another aspect, cured tobacco material provided herein comprises fire-cured tobacco material. In another aspect, cured tobacco material provided herein comprises sun-cured tobacco material. In another aspect, cured tobacco material provided herein comprises flue-cured tobacco material. In another aspect, cured tobacco material provided herein is selected from the group consisting of air-cured tobacco material, fire-cured tobacco material, sun-cured tobacco material, and flue-cured tobacco material.

Tobacco products provided herein include, without limitation, cigarette products (e.g., cigarettes, bidi cigarettes, kreteks), cigar products (e.g., cigars, cigar wrapping tobacco, cigarillos), pipe tobacco products, products derived from tobacco, tobacco-derived nicotine products, smokeless tobacco products (e.g., moist snuff, dry snuff, chewing tobacco, moist smokeless tobacco, fine cut chewing tobacco, long cut chewing tobacco, pouched chewing tobacco), films, chewables (e.g., gum), lozenges, dissolving strips, tabs, tablets, shaped parts, gels, consumable units, insoluble matrices, hollow shapes, reconstituted tobacco, expanded tobacco, and the like. See, for example, U.S. Patent Publication No. US 2006/0191548. In an aspect, a tobacco product is selected from the group consisting of a cigarette, a kretek, a bidi cigarette, a cigar, a cigarillo, a non-ventilated cigarette, a vented-recess filter cigarette, pipe tobacco, snuff, chewing tobacco, moist smokeless tobacco, fine cut chewing tobacco, long cut chewing tobacco, and pouched chewing tobacco. In another aspect, a tobacco product is selected from the group consisting of a gum, a tablet, a lozenge, and a dissolving strip. In another aspect, a tobacco product provided herein is a smokeless tobacco product.

Alkaloid compounds extracted from tobacco plants or tobacco plant parts provided herein can be used to produce compositions suitable for use with non-combustible products. Exemplary non-combustible products include electronic cigarettes ("e-cigarettes"), electronic smoking articles, e-vapor products, aerosolized vapor products, and heated tobacco products. In an aspect, a non-combustible product provided herein comprises an alkaloid extracted from a tobacco plant or tobacco plant part provided herein. In an aspect, a non-combustible product provided herein comprises nicotine extracted from a tobacco plant or tobacco plant part provided herein. In an aspect, a non-combustible product provided herein comprises anabasine extracted from a tobacco plant or tobacco plant part provided herein. In an aspect, a non-combustible product provided herein comprises anatabine extracted from a tobacco plant or tobacco plant part provided herein. In an aspect, a non-combustible product provided herein comprises nornicotine extracted from a tobacco plant or tobacco plant part provided herein.

In one aspect, a non-combustible product provided herein is an e-cigarette. In another aspect, a non-combustible product provided herein is an electronic smoking article. In another aspect, a non-combustible product provided herein is an aerosolized vapor product. In another aspect, a non-combustible product provided herein is a heated tobacco product. In another aspect, a non-combustible product provided herein is an e-vapor product. In an aspect, a non-combustible product provided herein is selected from the group consisting of an e-cigarette, an electronic smoking article, an aerosolized vapor product, and a heated tobacco product.

As used herein, "cigarette" refers a tobacco product having a "rod" and "filler". The cigarette "rod" includes the cigarette paper, filter, plug wrap (used to contain filtration materials), tipping paper that holds the cigarette paper (including the filler) to the filter, and all glues that hold these components together. The "filler" includes (1) all tobaccos, including but not limited to reconstituted and expanded tobacco, (2) non-tobacco substitutes (including but not limited to herbs, non-tobacco plant materials and other spices that may accompany tobaccos rolled within the cigarette paper), (3) casings, (4) flavorings, and (5) all other additives (that are mixed into tobaccos and substitutes and rolled into the cigarette).

In an aspect, this disclosure provides containers of tobacco leaves used to store, transport, or otherwise house cured or uncured tobacco leaves from tobacco plants described herein. As a non-limiting example, a container can be a box, a bag, a barrel, a crate, or any other suitable container.

In another aspect, this disclosure provides a bale of cured tobacco leaves from any tobacco plant provided herein. Also provided herein is a bale of uncured tobacco leaves from any tobacco plant provided herein. A bale can be any size known in the art. In one aspect, a bale comprises at least 1 kilogram. In another aspect, a bale comprises at least 5 kilograms. In another aspect, a bale comprises at least 10 kilograms. In another aspect, a bale comprises at least 15 kilograms. In another aspect, a bale comprises at least 20 kilograms. In another aspect, a bale comprises at least 25 kilograms. In another aspect, a bale comprises at least 30 kilograms. In another aspect, a bale comprises at least 35 kilograms. In another aspect, a bale comprises at least 40 kilograms. In another aspect, a bale comprises at least 45 kilograms. In another aspect, a bale comprises at least 50 kilograms. In another aspect, a bale comprises at least 60 kilograms. In another aspect, a bale comprises at least 70 kilograms. In another aspect, a bale comprises at least 80 kilograms. In another aspect, a bale comprises at least 90 kilograms. In another aspect, a bale comprises at least 100 kilograms. In another aspect, a bale comprises at least 125 kilograms. In another aspect, a bale comprises at least 150 kilograms. In another aspect, a bale comprises at least 175 kilograms. In another aspect, a bale comprises at least 200 kilograms. In another aspect, a bale comprises at least 225 kilograms. In another aspect, a bale comprises at least 250 kilograms. In another aspect, a bale comprises at least 275 kilograms. In another aspect, a bale comprises at least 300 kilograms. In another aspect, a bale comprises at least 350 kilograms. In another aspect, a bale comprises at least 400 kilograms. In another aspect, a bale comprises at least 450 kilograms. In another aspect, a bale comprises at least 500 kilograms. In another aspect, a bale comprises at least 600 kilograms. In another aspect, a bale comprises at least 700 kilograms. In another aspect, a bale comprises at least 800 kilograms. In another aspect, a bale comprises at least 900 kilograms. In another aspect, a bale comprises at least 1000 kilograms. In another aspect, a bale comprises at least 1500 kilograms. In another aspect, a bale comprises at least 2000 kilograms. A bale can be of any shape. Non-limiting examples of bale shapes include conical, spherical, rectangular, and cuboidal.

Also provided herein are containers of tobacco products from tobacco leaves harvested and cured from tobacco plants described herein. By way of non-limiting example, a container may be a box, a bag, a packet, a pack, a pouch, a tin, or any other container known in the art.

In one aspect, tobacco plants, seeds, plant components, plant cells, and plant genomes provided herein are from a tobacco type selected from the group consisting of flue-cured tobacco, sun-cured tobacco, air-cured tobacco, dark air-cured tobacco, and dark fire-cured tobacco. In another aspect, tobacco plants, seeds, plant components, plant cells, and plant genomes provided herein are from a tobacco type selected from the group consisting of Burley tobacco, Maryland tobacco, bright tobacco, Virginia tobacco, Oriental tobacco, Turkish tobacco, and Galpão tobacco. In one aspect, a tobacco plants or seed provided herein is a hybrid plants or seed. In one aspect, a tobacco plant provided herein is selected from the group consisting of a flue-cured variety tobacco plant, a bright variety tobacco plant, a Burley variety tobacco plant, a Virginia variety tobacco plant, a Maryland variety tobacco plant, a Galpão variety tobacco plant, a dark variety tobacco plant, an Oriental variety tobacco plant, and a Turkish variety tobacco plant.

As used herein, a "hybrid" is created by crossing two plants from different varieties or species, such that the progeny comprises genetic material from each parent. Skilled artisans recognize that higher order hybrids can be generated as well. For example, a first hybrid can be made by crossing Variety C with Variety D to create a C×D hybrid, and a second hybrid can be made by crossing Variety E with Variety F to create an E×F hybrid. The first and second hybrids can be further crossed to create the higher order hybrid (C×D)×(E×F) comprising genetic information from all four parent varieties. In an aspect, a tobacco plant provided herein is a hybrid tobacco plant. In another aspect, a tobacco seed provided herein is a hybrid tobacco seed.

In one aspect, a tobacco variety provided herein is male sterile. In another aspect, a tobacco variety provided herein is cytoplasmic male sterile (CMS). In an aspect, a tobacco plant provided herein is male sterile. In another aspect, a tobacco plant provided herein is cytoplasmic male sterile. Male sterile tobacco plants may be produced by any method known in the art. Methods of producing male sterile tobacco are described in Wernsman, E. A., and Rufty, R. C. 1987. Chapter Seventeen. Tobacco. Pages 669-698 In: Cultivar Development. Crop Species. W. H. Fehr (ed.), MacMillan Publishing Go., Inc., New York, N.Y. 761 pp. In another aspect, a tobacco variety provided herein is female sterile. As a non-limiting example, female sterile plants can be made by mutating the STIG1 gene. See, for example, Goldman et al. 1994, *EMBO Journal* 13:2976-2984. In an aspect, a tobacco plant provided herein is female sterile.

In one aspect, a tobacco variety provided herein is produced via haploid doubling. Haploid doubling occurs when a haploid line is induced to double its chromosome complement to a diploid state that is homozygous at all loci within the genome.

Flue-cured tobaccos (also called Virginia of bright tobaccos) amount to approximately 40% of world tobacco production. Flue-cured tobaccos are often also referred to as "bright tobacco" because of the golden-yellow to deep-orange color it reaches during curing. Flue-cured tobaccos have a light, bright aroma and taste. Flue-cured tobaccos are generally high in sugar and low in oils. Major flue-cured tobacco growing countries are Argentina, Brazil, China, India, Tanzania and the U.S. In one aspect, tobacco plants or seeds provided herein are in a flue-cured tobacco background selected from the group consisting of CC 13, CC 27, CC 33, CC35, CC 37, CC 65, CC 67, CC 700, GF 318, GL 338, GL 368, GL 939, K 346, K 399, K326, NC 102, NC 196, NC 291, NC 297, NC 299, NC 471, NC 55, NC 606, NC 71, NC 72, NC 92, PVH 1118, PVH 1452, PVH 2110, SPEIGHT 168, SPEIGHT 220, SPEIGHT 225, SPEIGHT 227, SPEIGHT 236, and any variety essentially derived from any one of the foregoing varieties. In another aspect, tobacco plants or seeds provided herein are in a flue-cured tobacco background selected from the group consisting of Coker 48, Coker 176, Coker 371-Gold, Coker 319, Coker 347, GL 939, K 149, K326, K 340, K 346, K 358, K 394, K 399, K 730, NC 27NF, NC 37NF, NC 55, NC 60, NC 71, NC 72, NC 82, NC 95, NC 297, NC 606, NC 729, NC 2326, McNair 373, McNair 944, Ox 207, Ox 414 NF, Reams 126, Reams 713, Reams 744, RG 8, RG 11, RG 13, RG 17, RG 22, RG 81, RG H4, RG H51, Speight H-20, Speight G-28, Speight G-58, Speight G-70, Speight G-108, Speight G-111, Speight G-117, Speight 168, Speight 179, Speight NF-3, Va 116, Va 182, and any variety essentially derived from any one of the foregoing varieties. See WO 2004/041006 A1. In further aspects, tobacco plants, seeds, hybrids, varieties, or lines provided herein are in any flue cured background selected from the group consisting of K326, K346, and NC196.

Air-cured tobaccos include Burley, Md., and dark tobaccos. The common factor is that curing is primarily without artificial sources of heat and humidity. Burley tobaccos are light to dark brown in color, high in oil, and low in sugar. Burley tobaccos are air-cured in barns. Major Burley growing countries are Argentina, Brazil, Italy, Malawi, and the U.S. Maryland tobaccos are extremely fluffy, have good burning properties, low nicotine and a neutral aroma. Major Maryland growing countries include the U.S. and Italy. In one aspect, tobacco plants or seeds provided herein are in a Burley tobacco background selected from the group consisting of Clay 402, Clay 403, Clay 502, Ky 14, Ky 907, Ky 910, Ky 8959, NC 2, NC 3, NC 4, NC 5, NC 2000, TN 86, TN 90, TN 97, R 610, R 630, R 711, R 712, NCBH 129, HB4488PLC, PD 7319LC, Bu 21×Ky 10, HBO4P, Ky 14×L 8, Kt 200, Newton 98, Pedigo 561, Pf561 and Va 509. In further aspects, tobacco plants, seeds, hybrids, varieties, or lines provided herein are in any Burley background selected from the group consisting of TN 90, KT 209, KT 206, KT212, and HB 4488. In another aspect, tobacco plants or seeds provided herein are in a Maryland tobacco background selected from the group consisting of Md 10, Md 40, Md 201, Md 609, Md 872 and Md 341.

Dark air-cured tobaccos are distinguished from other types primarily by its curing process which gives dark air-cured tobacco its medium- to dark-brown color and distinct aroma. Dark air-cured tobaccos are mainly used in the production of chewing tobacco and snuff. In one aspect, tobacco plants or seeds provided herein are in a dark air-cured tobacco background selected from the group consisting of Sumatra, Jatim, Dominican Cubano, Besuki, One sucker, Green River, Va. sun-cured, and Paraguan Passado.

Dark fire-cured tobaccos are generally cured with low-burning wood fires on the floors of closed curing barns. Dark fire-cured tobaccos are used for making pipe blends, cigarettes, chewing tobacco, snuff and strong-tasting cigars. Major growing regions for dark fire-cured tobaccos are Tennessee, Kentucky, and Virginia, USA. In one aspect, tobacco plants or seeds provided herein are in a dark fire-cured tobacco background selected from the group consisting of Narrow Leaf Madole, Improved Madole, Tom Rosson Madole, Newton's VH Madole, Little Crittenden, Green Wood, Little Wood, Small Stalk Black Mammoth, DT 508, DT 518, DT 592, KY 171, DF 911, DF 485, TN D94, TN D950, VA 309, and VA 359.

Oriental tobaccos are also referred to as Greek, aroma and Turkish tobaccos due to the fact that they are typically grown in eastern Mediterranean regions such as Turkey, Greece, Bulgaria, Macedonia, Syria, Lebanon, Italy, and Romania. The small plant and leaf size, characteristic of today's Oriental varieties, as well as its unique aroma properties are a result of the plant's adaptation to the poor soil and stressful climatic conditions in which it develop over many past centuries. In one aspect, tobacco plants or seeds provided herein are in an Oriental tobacco background selected from the group consisting of Izmir, Katerini, Samsun, Basma and Krumovgrad, Trabzon, Thesalian, Tasova, Sinop, Izmit, Hendek, Edirne, Semdinli, Adiyanman, Yayladag, Iskenderun, Duzce, Macedonian, Mavra, Prilep, Bafra, Bursa, Bucak, Bitlis, Balikesir, and any variety essentially derived from any one of the foregoing varieties.

In one aspect, tobacco plants, seeds, hybrids, varieties, or lines provided herein are essentially derived from or in the genetic background of BU 64, CC 101, CC 200, CC 13, CC 27, CC 33, CC 35, CC 37, CC 65, CC 67, CC 301, CC 400, CC 500, CC 600, CC 700, CC 800, CC 900, CC 1063, Coker 176, Coker 319, Coker 371 Gold, Coker 48, CU 263, DF911, Galpão, GL 26H, GL 338, GL 350, GL 395, GL 600, GL 737, GL 939, GL 973, GF 157, GF 318, RJR 901, HB 04P, K 149, K 326, K 346, K 358, K394, K 399, K 730, NC 196, NC 37NF, NC 471, NC 55, NC 92, NC2326, NC 95, NC 925, PVH 1118, PVH 1452, PVH 2110, PVH 2254, PVH 2275, VA 116, VA 119, KDH 959, KT 200, KT204LC, KY 10, KY 14, KY 160, KY 17, KY 171, KY 907, KY 907LC, KTY14×L8 LC, Little Crittenden, McNair 373, McNair 944, male sterile KY 14×L8, Narrow Leaf Madole, MS KY171, Narrow Leaf Madole (phph), MS Narrow Leaf Madole, MS TND950, PD 7302LC, PD 7305LC, PD 7309LC, PD 7312LC, PD 7318LC, PD 7319LC, MSTKS 2002, TKF 2002, TKF 6400, TKF 4028, TKF 4024, KT206LC, KT209LC, KT210LC, KT212LC, NC 100, NC 102, NC 2000, NC 291, NC 297, NC 299, NC 3, NC 4, NC 5, NC 6, NC7, NC 606, NC 71, NC 72, NC 810, NC BH 129, NC 2002, Neal Smith Madole, OXFORD 207, 'Perique', PVH03, PVH09, PVH19, PVH50, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN90LC, TN 97, TN97LC, TN D94, TN D950, a TR (Tom Rosson) Madole, VA 309, VA 359, or any commercial tobacco variety according to standard tobacco breeding techniques known in the art.

In one aspect, a tobacco plant provided herein is selected from the group consisting of a BU 64 plant, a CC 101 plant, a CC 200 plant, a CC 13 plant, a CC 27 plant, a CC 33 plant, a CC 35 plant, a CC 37 plant, a CC 65 plant, a CC 67 plant, a CC 301 plant, a CC 400 plant, a CC 500 plant, CC 600 plant, a CC 700 plant, a CC 800 plant, a CC 900 plant, a CC 1063 plant, a Coker 176 plant, a Coker 319 plant, a Coker 371 Gold plant, a Coker 48 plant, a CU 263 plant, a DF911 plant, a Galpão plant, a GL 26H plant, a GL 338 plant, a GL 350 plant, a GL 395 plant, a GL 600 plant, a GL 737 plant, a GL 939 plant, a GL 973 plant, a GF 157 plant, a GF 318 plant, an RJR 901 plant, an HB 04P plant, a K 149 plant, a K 326 plant, a K 346 plant, a K 358 plant, a K394 plant, a K 399 plant, a K 730 plant, an NC 196 plant, an NC 37NF plant, an NC 471 plant, an NC 55 plant, an NC 92 plant, an NC2326 plant, an NC 95 plant, an NC 925 plant, a PVH 1118 plant, a PVH 1452 plant, a PVH 2110 plant, a PVH 2254 plant, a PVH 2275 plant, a VA 116 plant, a VA 119 plant, a KDH 959 plant, a KT 200 plant, a KT204LC plant, a KY 10 plant, a KY 14 plant, a KY 160 plant, a KY 17 plant, a KY 171 plant, a KY 907 plant, a KY 907LC plant, a KTY14×L8 LC plant, a Little Crittenden plant, a McNair 373 plant, a McNair 944 plant, a male sterile KY 14×L8 plant, a Narrow Leaf Madole plant, a MS KY171 plant, a Narrow Leaf Madole (phph) plant, a MS Narrow Leaf Madole plant, a MS TND950 plant, a PD 7302LC plant, a PD 7305LC plant, a PD 7309LC plant, a PD 7312LC plant, a PD 7318LC plant, a PD 7319LC plant, a MSTKS 2002 plant, a TKF 2002 plant, a TKF 6400 plant, a TKF 4028 plant, a TKF 4024 plant, a KT206LC plant, a KT209LC plant, a KT210LC plant, a KT212LC plant, an NC 100 plant, an NC 102 plant, an NC 2000 plant, an NC 291 plant, an NC 297 plant, an NC 299 plant, an NC 3 plant, an NC 4 plant, an NC 5 plant, an NC 6 plant, an NC7 plant, an NC 606 plant, an NC 71 plant, an NC 72 plant, an NC 810 plant, an NC BH 129 plant, an NC 2002 plant, a Neal Smith Madole plant, an OXFORD 207 plant, a 'Perique' plant, a PVH03 plant, a PVH09 plant, a PVH19 plant, a PVH50 plant, a PVH51 plant, an R 610 plant, an R 630 plant, an R 7-11 plant, an R 7-12 plant, an RG 17 plant, an RG 81 plant, an RG H51 plant, an RGH 4 plant, an RGH 51 plant, an RS 1410 plant, a Speight 168 plant, a Speight 172 plant, a Speight 179 plant, a Speight 210 plant, a Speight 220 plant, a Speight 225 plant, a Speight 227 plant, a Speight 234 plant, a Speight G-28 plant, a Speight G-70 plant, a Speight H-6 plant, a Speight H20 plant, a Speight NF3 plant, a TI 1406 plant, a TI 1269 plant, a TN 86 plant, a TN86LC plant, a TN 90 plant, a TN90LC plant, a TN 97 plant, a TN97LC plant, a TN D94 plant, a TN D950 plant, a TR (Tom Rosson) Madole plant, a VA 309 plant, and a VA 359 plant.

All foregoing mentioned specific varieties of dark air-cured, Burley, Md., dark fire-cured, or Oriental type are only listed for exemplary purposes. Any additional dark air-cured, Burley, Md., dark fire-cured, Oriental varieties are also contemplated in the present application.

In one aspect, this disclosure provides a method for controlling topping-induced suckers in a tobacco plant comprising: (a) introducing a nucleic acid molecule to a tobacco cell, where the nucleic acid molecule comprises a promoter active in axillary bud tissue, where the promoter: (i) comprises a sequence having at least 75% identity to SEQ ID NO: 113, where the identity is based on, and limited to, the entire alignable region or regions between said sequence and SEQ ID NO: 113; (ii) comprises a deletion of at least 50 contiguous nucleotides as compared to SEQ ID NO: 113; and (iii) is operably linked to a heterologous nucleic acid molecule encoding an axillary bud-degrading product; and (b) regenerating a tobacco plant from the tobacco cell, where the tobacco plant comprises no or reduced topping-induced suckers as compared to a control tobacco plant grown under comparable conditions.

Also provided herein are the transformation of tobacco plants with recombinant constructs or expression cassettes described herein using any suitable transformation methods known in the art. Methods for introducing polynucleotide sequences into tobacco plants are known in the art and include, but are not limited to, stable transformation methods, transient transformation methods, and virus-mediated methods. "Stable transformation" refers to transformation where the nucleotide construct of interest introduced into a plant integrates into a genome of the plant and is capable of being inherited by the progeny thereof. "Transient transformation" is intended to mean that a sequence is introduced into the plant and is only temporally expressed or is only transiently present in the plant.

In one aspect, methods and compositions provided herein comprise the introduction of one or more polynucleotides into one or more plant cells. In one aspect, a plant genome provided herein is modified to include an introduced nucleic acid molecule or recombinant vector. As used herein, "plant genome" refers to a nuclear genome, a mitochondrial genome, or a plastid (e.g., chloroplast) genome of a plant cell. In another aspect, a polynucleotide provided herein is integrated into an artificial chromosome. In one aspect, an artificial chromosome comprising a polynucleotide provided herein is integrated into a plant cell.

Suitable methods of introducing nucleic acid molecules (e.g., transgenes, recombinant vectors, recombinant DNA constructs, recombinant polynucleotides, expression constructs) into plant cells of the present disclosure include microinjection, electroporation, *Agrobacterium*-mediated transformation (U.S. Pat. Nos. 5,104,310, 5,149,645, 5,177, 010, 5,231,019, 5,463,174, 5,464,763, 5,469,976, 4,762,785, 5,004,863, 5,159,135, 5,563,055, and 5,981,840), direct gene transfer, and ballistic particle acceleration (also known as biolistic delivery; see, for example, U.S. Pat. Nos. 4,945, 050, 5,141,131, 5,886,244, 5,879,918, and 5,932,782). In an aspect, a method of introducing a nucleic acid molecule to a tobacco cell comprises *Agrobacterium*-mediated transformation. In another aspect, a method of introducing a nucleic acid molecule to a tobacco cell comprises electroporation. In an aspect, a method of introducing a nucleic acid molecule to a tobacco cell comprises *Agrobacterium*-mediated transformation. In an aspect, a method of introducing a nucleic acid molecule to a tobacco cell comprises biolistic delivery.

Nucleic acid molecules provided herein may be introduced into plants by contacting plants with a virus or viral nucleic acids. Generally, such methods involve incorporating an expression cassette of the present disclosure within a viral DNA or RNA molecule. It is recognized that promoters for use in the expression cassettes provided herein also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931.

Any plant tissue that can be subsequently propagated using clonal methods, whether by organogenesis or embryogenesis, may be transformed with a recombinant construct or an expression cassette provided herein. By "organogenesis" in intended the process by which shoots and roots are developed sequentially from meristematic centers. By "embryogenesis" is intended the process by which shoots and roots develop together in a concerted fashion (not sequentially), whether from somatic cells or gametes. Exemplary tissues that are suitable for various transformation protocols described herein include, but are not limited to, protoplast cells, callus tissue, existing meristematic tissue (e.g., apical meristems, axillary buds, and root meristems) and induced meristem tissue (e.g., cotyledon meristem and hypocotyl meristem), hypocotyls, cotyledons, leaf disks, pollen, embryos, and the like. In one aspect, a transformed cell comprises a protoplast cell. In another aspect, a transformed cell comprises a callus cell.

In one aspect, this disclosure provides a method of growing a tobacco plant comprising planting a tobacco seed comprising a nucleic acid molecule, where the nucleic acid molecule comprises a promoter active in axillary bud tissue, where the promoter: (a) comprises a sequence having at least 75% identity to SEQ ID NO: 113, where the identity is based on, and limited to, the entire alignable region or regions between said sequence and SEQ ID NO: 113; (b) comprises a deletion of at least 50 contiguous nucleotides as compared to SEQ ID NO: 113; and (c) is operably linked to a heterologous nucleic acid molecule encoding an axillary bud-degrading product, where the tobacco seed germinates into a tobacco plant comprising no or reduced topping-induced suckers as compared to a control tobacco plant grown under comparable conditions.

As used herein, "planting" refers to providing a seed with conditions suitable to induce germination of the seed. In an aspect, a tobacco seed is planted in a field. In another aspect, a tobacco seed is planted in a greenhouse. In another aspect, a tobacco seed is planted in a growth chamber. In another aspect, a tobacco seed is planted in a laboratory. In another aspect, a tobacco seed is planted in a hydroponic growth system. In another aspect, a tobacco seed is planted in a pot. In an aspect, a tobacco seed is planted outdoors. In another aspect, a tobacco seed is planted indoors. In another aspect, a tobacco seed is planted in a growth medium. Non-limiting examples of growth medium include soil, clay, sand, loam, compost, manure, mulch, and combinations thereof.

The following exemplary, non-limiting embodiments are envisioned:

1. A nucleic acid molecule comprising a promoter active in axillary bud tissue, wherein said promoter:
   (a) comprises a sequence having at least 75% identity to SEQ ID NO: 113, wherein said identity is based on, and limited to, the entire alignable region or regions between said sequence and SEQ ID NO: 113;
   (b) comprises a deletion of at least 50 contiguous nucleotides as compared to SEQ ID NO: 113; and
   (c) is operably linked to a heterologous nucleic acid molecule.
2. The nucleic acid molecule of embodiment 1, wherein said promoter comprises between 50 nucleotides and 2450 nucleotides.
3. The nucleic acid molecule of embodiment 1, wherein said promoter comprises at least 50 nucleotides.
4. The nucleic acid molecule of embodiment 1, wherein said promoter comprises at least 500 nucleotides.
5. The nucleic acid molecule of embodiment 1, wherein said promoter comprises at least 1000 nucleotides.
6. The nucleic acid molecule of embodiment 1, wherein said promoter comprises at least 2000 nucleotides.
7. The nucleic acid molecule of any one of embodiments 1 to 6, wherein said promoter comprises two or fewer sugar repressive elements.
8. The nucleic acid molecule of any one of embodiments 1 to 6, wherein said deletion comprises the deletion of at least one sugar repressive element.
9. The nucleic acid molecule of any one of embodiments 1 to 6, wherein said deletion comprises the deletion of at least two sugar repressive elements.
10. The nucleic acid molecule of any one of embodiments 1 to 9, wherein said deletion comprises the deletion of an axillary bud up2 element.
11. The nucleic acid molecule of any one of embodiments 1 to 10, wherein said deletion comprises the deletion of at least one sugar repressive element and at least one axillary bud up2 element.
12. The nucleic acid molecule of any one of embodiments 1 to 11, wherein said deletion comprises the deletion of at least one bud dormancy element.
13. The nucleic acid molecule of any one of embodiments 1 to 12, wherein said deletion comprises the deletion of at least 75 contiguous nucleotides as compared to SEQ ID NO: 113.
14. The nucleic acid molecule of any one of embodiments 1 to 13, wherein said deletion comprises the deletion of at least 100 contiguous nucleotides as compared to SEQ ID NO: 113.
15. The nucleic acid molecule of any one of embodiments 1 to 14, wherein said deletion comprises the deletion of at least 200 contiguous nucleotides as compared to SEQ ID NO: 113.
16. The nucleic acid molecule of any one of embodiments 1 to 15, wherein said deletion comprises the deletion of at least 500 contiguous nucleotides as compared to SEQ ID NO: 113.
17. The nucleic acid molecule of any one of embodiments 1 to 16, wherein said promoter comprises a nucleic acid sequence at least 85% identical to SEQ ID NO: 257.
18. The nucleic acid molecule of any one of embodiments 1 to 17, wherein said heterologous nucleic acid molecule encodes at least one axillary bud-degrading product.
19. The nucleic acid molecule of embodiment 18, wherein said at least one axillary bud-degrading product is selected from the group consisting of a small RNA molecule and a polypeptide.
20. The nucleic acid molecule of embodiment 19, wherein said polypeptide comprises an amino acid sequence at least 70% identical or similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

21. The nucleic acid molecule of embodiment 19, wherein said small RNA molecule comprises at least 18 contiguous nucleotides identical or complementary to a polynucleotide selected from the group consisting of SEQ ID NOs: 83-101.

22. A tobacco plant comprising a nucleic acid molecule comprising a promoter active in axillary bud tissue, wherein said promoter:
(a) comprises a sequence having at least 75% identity to SEQ ID NO: 113, wherein said identity is based on, and limited to, the entire alignable region or regions between said sequence and SEQ ID NO: 113;
(b) comprises a deletion of at least 50 contiguous nucleotides as compared to SEQ ID NO: 113; and
(c) is operably linked to a heterologous nucleic acid molecule,
wherein said tobacco plant comprises no suckers or reduced suckers after topping as compared to a control tobacco plant of the same variety when grown under comparable conditions.

23. The tobacco plant of embodiment 22, wherein said promoter comprises between 50 nucleotides and 2450 nucleotides.

24. The tobacco plant of embodiment 22, wherein said promoter comprises at least 50 nucleotides.

25. The tobacco plant of embodiment 22, wherein said promoter comprises at least 500 nucleotides.

26. The tobacco plant of embodiment 22, wherein said promoter comprises at least 1000 nucleotides.

27. The tobacco plant of embodiment 22, wherein said promoter comprises at least 2000 nucleotides.

28. The tobacco plant of any one of embodiments 22 to 27, wherein said promoter comprises two or fewer sugar repressive elements.

29. The tobacco plant of any one of embodiments 22 to 27, wherein said deletion comprises the deletion of at least one sugar repressive element.

30. The tobacco plant of any one of embodiments 22 to 27, wherein said deletion comprises the deletion of at least two sugar repressive elements.

31. The tobacco plant of any one of embodiments 22 to 30, wherein said deletion comprises the deletion of an axillary bud up2 element.

32. The tobacco plant of any one of embodiments 22 to 31, wherein said deletion comprises the deletion of at least one sugar repressive element and at least one axillary bud up2 element.

33. The tobacco plant of any one of embodiments 22 to 32, wherein said deletion comprises the deletion of at least one bud dormancy element.

34. The tobacco plant of any one of embodiments 22 to 33, wherein said deletion comprises the deletion of at least 75 contiguous nucleotides as compared to SEQ ID NO: 113.

35. The tobacco plant of any one of embodiments 22 to 34, wherein said deletion comprises the deletion of at least 100 contiguous nucleotides as compared to SEQ ID NO: 113.

36. The tobacco plant of any one of embodiments 22 to 35, wherein said deletion comprises the deletion of at least 200 contiguous nucleotides as compared to SEQ ID NO: 113.

37. The tobacco plant of any one of embodiments 22 to 36, wherein said deletion comprises the deletion of at least 500 contiguous nucleotides as compared to SEQ ID NO: 113.

38. The tobacco plant of any one of embodiments 22 to 37, wherein said promoter comprises a nucleic acid sequence at least 85% identical to SEQ ID NO: 257.

39. The tobacco plant of any one of embodiments 22 to 38, wherein said promoter is active in axillary meristem tissue.

40. The tobacco plant of any one of embodiments 22 to 39, wherein said promoter is active in axillary meristem tissue at least 7 days after said topping.

41. The tobacco plant of any one of embodiments 22 to 40, wherein said promoter is not active in a seedling tobacco plant.

42. The tobacco plant of any one of embodiments 22 to 41, wherein said promoter is not active in shoot apical meristem tissue.

43. The tobacco plant of any one of embodiments 22 to 42, wherein said no suckers or reduced suckers is measured one week after said topping.

44. The tobacco plant of any one of embodiments 22 to 43, wherein said no suckers or reduced suckers is measured four weeks after said topping.

45. The tobacco plant of any one of embodiments 22 to 44, wherein said reduced suckers comprises at least 10% fewer suckers.

46. The tobacco plant of any one of embodiments 22 to 45, wherein said reduced suckers comprises reduced dry biomass of the suckers, reduced fresh weight of the suckers, reduced length of the suckers, reduced diameter of the suckers, reduced number of total suckers, or any combination thereof.

47. The tobacco plant of any one of embodiments 22 to 46, wherein said tobacco plant comprises a higher leaf yield mass as compared to said control tobacco plant.

48. The tobacco plant of any one of embodiments 22 to 47, wherein said tobacco plant comprises a height that is equal to or greater than the height of said control plant.

49. The tobacco plant of any one of embodiments 22 to 48, wherein said tobacco plant is selected from the group consisting a BU 64 plant, a CC 101 plant, a CC 200 plant, a CC 13 plant, a CC 27 plant, a CC 33 plant, a CC 35 plant, a CC 37 plant, a CC 65 plant, a CC 67 plant, a CC 301 plant, a CC 400 plant, a CC 500 plant, CC 600 plant, a CC 700 plant, a CC 800 plant, a CC 900 plant, a CC 1063 plant, a Coker 176 plant, a Coker 319 plant, a Coker 371 Gold plant, a Coker 48 plant, a CU 263 plant, a DF911 plant, a Galpão plant, a GL 26H plant, a GL 338 plant, a GL 350 plant, a GL 395 plant, a GL 600 plant, a GL 737 plant, a GL 939 plant, a GL 973 plant, a GF 157 plant, a GF 318 plant, an RJR 901 plant, an HB 04P plant, a K 149 plant, a K 326 plant, a K 346 plant, a K 358 plant, a K394 plant, a K 399 plant, a K 730 plant, an NC 196 plant, an NC 37NF plant, an NC 471 plant, an NC 55 plant, an NC 92 plant, an NC2326 plant, an NC 95 plant, an NC 925 plant, a PVH 1118 plant, a PVH 1452 plant, a PVH 2110 plant, a PVH 2254 plant, a PVH 2275 plant, a VA 116 plant, a VA 119 plant, a KDH 959 plant, a KT 200 plant, a KT204LC plant, a KY 10 plant, a KY 14 plant, a KY 160 plant, a KY 17 plant, a KY 171 plant, a KY 907 plant, a KY 907LC plant, a KTY14×L8 LC plant, a Little Crittenden plant, a McNair 373 plant, a McNair 944 plant, a male sterile KY 14×L8 plant, a Narrow Leaf Madole plant, a MS KY171 plant, a Narrow Leaf Madole (phph) plant, a MS Narrow Leaf Madole plant, a MS TND950 plant, a PD 7302LC plant, a PD 7305LC plant, a PD 7309LC plant, a PD 7312LC plant, a PD 7318LC plant, a PD 7319LC plant, a MSTKS 2002 plant, a TKF 2002 plant, a TKF 6400 plant, a TKF 4028 plant, a TKF 4024 plant, a KT206LC plant, a KT209LC plant, a KT210LC plant, a KT212LC plant, an NC 100 plant, an NC 102 plant, an NC 2000 plant, an NC 291 plant, an NC 297 plant, an NC 299 plant, an NC 3 plant, an NC 4 plant, an NC 5 plant, an NC 6 plant, an NC7 plant, an NC 606 plant, an NC 71 plant, an NC 72 plant, an NC 810 plant, an NC BH 129 plant, an NC 2002 plant, a Neal Smith Madole plant, an OXFORD 207 plant, a 'Perique' plant, a PVH03 plant, a PVH09 plant, a PVH19 plant, a PVH50 plant, a PVH51 plant, an R 610 plant, an R 630 plant, an R 7-11 plant, an R 7-12 plant, an RG 17 plant, an RG 81 plant, an RG H51 plant, an RGH 4 plant, an RGH 51 plant, an RS 1410 plant, a Speight 168 plant, a Speight 172 plant, a Speight 179 plant, a Speight 210 plant, a Speight 220 plant, a Speight 225 plant, a Speight 227 plant, a Speight 234 plant, a Speight G-28 plant, a Speight G-70 plant, a Speight H-6 plant, a Speight H20 plant, a Speight NF3 plant, a TI 1406 plant, a TI 1269 plant, a TN 86 plant, a TN86LC plant, a TN 90 plant, a TN90LC plant, a TN 97 plant, a TN97LC plant, a TN D94 plant, a TN D950 plant, a TR (Tom Rosson) Madole plant, a VA 309 plant, and a VA 359 plant.

50. The tobacco plant of any one of embodiments 22 to 49, wherein said tobacco plant is selected from the group consisting of a flue-cured variety tobacco plant, a bright variety tobacco plant, a Burley variety tobacco plant, a Virginia variety tobacco plant, a Maryland variety tobacco plant, a Galpão variety tobacco plant, a dark variety tobacco plant, an Oriental variety tobacco plant, and a Turkish variety tobacco plant.

51. The tobacco plant of any one of embodiments 22 to 50, wherein said tobacco plant is a hybrid tobacco plant.

52. The tobacco plant of any one of embodiments 22 to 51, wherein said tobacco plant is a female sterile tobacco plant.

53. The tobacco plant of any one of embodiments 22 to 52, wherein said tobacco plant is a male sterile tobacco plant.

54. The tobacco plant of embodiment 53, wherein said male sterile tobacco plant is a cytoplasmically male sterile tobacco plant.

55. The tobacco plant of any one of embodiments 22 to 54, wherein said heterologous nucleic acid molecule encodes at least one axillary bud-degrading product.

56. The tobacco plant of embodiment 55, wherein said at least one axillary bud-degrading product is selected from the group consisting of a small RNA molecule and a polypeptide.

57. The tobacco plant of embodiment 56, wherein said polypeptide comprises an amino acid sequence at least 70% identical or similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

58. The tobacco plant of embodiment 56, wherein said small RNA molecule comprises at least 18 contiguous nucleotides identical or complementary to a polynucleotide selected from the group consisting of SEQ ID NOs: 83-101.

59. A tobacco leaf of the tobacco plant of any one of embodiments 22 to 58.

60. A tobacco product comprising cured tobacco material from the tobacco plant of any one of embodiments 22 to 58.

61. A tobacco product comprising an alkaloid extracted from the tobacco plant, or a part thereof, of claim 22.

62. The tobacco product of claim 60 or 61, wherein said alkaloid is selected from the group consisting of nicotine, nornicotine, anatabine, and anabasine.

63. The tobacco product of embodiment 60, wherein said tobacco product is selected from the group consisting of a cigarette, a kretek, a bidi cigarette, a cigar, a cigarillo, a non-ventilated cigarette, a vented recess filter cigarette, pipe tobacco, snuff, chewing tobacco, moist smokeless tobacco, fine cut chewing tobacco, long cut chewing tobacco, and pouched chewing tobacco product.

64. The tobacco product of embodiment 60, wherein said tobacco product is selected from the group consisting of a gum, a tablet, a lozenge, and a dissolving strip.

65. The tobacco product of any one of embodiments 60 to 64, wherein said tobacco product is a smokeless tobacco product.

66. The tobacco product of claim 61 or 62, wherein said tobacco product is selected from the group consisting of an electronic cigarette, an electronic smoking article, an aerosolized vapor product, and a heated tobacco product.

67. The tobacco product of any one of embodiments 60 or 62 to 66, wherein said cured tobacco material is selected from the group consisting of air-cured tobacco material, fire-cured tobacco material, sun-cured tobacco material, and flue-cured tobacco material.

68. A plant or seed comprising a nucleic acid molecule, wherein said nucleic acid molecule comprises a promoter active in axillary bud tissue, wherein said promoter:
   (a) comprises a sequence having at least 75% identity to SEQ ID NO: 113, wherein said identity is based on, and limited to, the entire alignable region or regions between said sequence and SEQ ID NO: 113;
   (b) comprises a deletion of at least 50 contiguous nucleotides as compared to SEQ ID NO: 113; and
   (c) is operably linked to a heterologous nucleic acid molecule encoding an axillary bud-degrading product.

69. The plant or seed of embodiment 68, wherein said promoter comprises between 50 nucleotides and 2450 nucleotides.

70. The plant or seed of embodiment 68, wherein said promoter comprises at least 50 nucleotides.

71. The plant or seed of embodiment 68, wherein said promoter comprises at least 500 nucleotides.

72. The plant or seed of embodiment 68, wherein said promoter comprises at least 1000 nucleotides.

73. The plant or seed of embodiment 68, wherein said promoter comprises at least 2000 nucleotides.

74. The plant or seed of any one of embodiments 68 to 73, wherein said promoter comprises a nucleic acid sequence at least 85% identical to SEQ ID NO: 257.

75. The plant or seed of any one of embodiments 68 to 73, wherein said plant or seed is a tobacco plant or a tobacco seed.

76. The plant of any one of embodiments 68 to 74, wherein said plant comprises no or reduced suckers as compared to a control plant when grown under comparable conditions.

77. The plant or seed of any one of embodiments 68 to 75, wherein said axillary bud-degrading product is selected from the group consisting of a small RNA molecule and a polypeptide.

78. The plant or seed of embodiment 77, wherein said polypeptide comprises an amino acid sequence at least 70% identical or similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

79. The plant or seed of embodiment 77, wherein said small RNA molecule comprises at least 18 contiguous nucleotides identical or complementary to a polynucleotide selected from the group consisting of SEQ ID NOs: 83-101.

80. A method for controlling topping-induced suckers in a tobacco plant comprising:
(a) introducing a nucleic acid molecule to a tobacco cell, wherein said nucleic acid molecule comprises a promoter active in axillary bud tissue, wherein said promoter:
   (i) comprises a sequence having at least 75% identity to SEQ ID NO: 113, wherein said identity is based on, and limited to, the entire alignable region or regions between said sequence and SEQ ID NO: 113;
   (ii) comprises a deletion of at least 50 contiguous nucleotides as compared to SEQ ID NO: 113; and
   (iii) is operably linked to a heterologous nucleic acid molecule encoding an axillary bud-degrading product; and
(b) regenerating a tobacco plant from said tobacco cell, wherein said tobacco plant comprises no or reduced topping-induced suckers as compared to a control tobacco plant grown under comparable conditions.

81. The method of embodiment 80, wherein said introducing comprises *Agrobacterium*-mediated transformation.

82. The method of embodiment 80, wherein said introducing comprises electroporation.

83. The method of embodiment 80, wherein said introducing comprises biolistic delivery of said nucleic acid molecule.

84. The method of any one of embodiments 80 to 83, wherein said tobacco cell is a protoplast cell.

85. The method of any one of embodiments 80 to 83, wherein said tobacco cell is a callus cell.

86. The method of any one of embodiments 80 to 83, wherein said tobacco cell is selected from the group consisting of a seed cell, a fruit cell, a leaf cell, a cotyledon cell, a hypocotyl cell, a meristem cell, an embryo cell, an endosperm cell, a root cell, a shoot cell, a stem cell, a flower cell, an inflorescence cell, a stalk cell, a pedicel cell, a style cell, a stigma cell, a receptacle cell, a petal cell, a sepal cell, a pollen cell, an anther cell, a filament cell, an ovary cell, an ovule cell, a pericarp cell, and a phloem cell.

87. A method of growing a tobacco plant comprising planting a tobacco seed comprising a nucleic acid molecule, wherein said nucleic acid molecule comprises a promoter active in axillary bud tissue, wherein said promoter:
(a) comprises a sequence having at least 75% identity to SEQ ID NO: 113, wherein said identity is based on, and limited to, the entire alignable region or regions between said sequence and SEQ ID NO: 113;
(b) comprises a deletion of at least 50 contiguous nucleotides as compared to SEQ ID NO: 113; and
(c) is operably linked to a heterologous nucleic acid molecule encoding an axillary bud-degrading product, wherein said tobacco seed germinates into a tobacco plant comprising no or reduced topping-induced suckers as compared to a control tobacco plant grown under comparable conditions.

88. The method of any one of embodiments 80 to 87, wherein said promoter comprises between 50 nucleotides and 2450 nucleotides.

89. The method of any one of embodiments 80 to 87, wherein said promoter comprises at least 50 nucleotides.

90. The method of any one of embodiments 80 to 87, wherein said promoter comprises at least 500 nucleotides.

91. The method of any one of embodiments 80 to 87, wherein said promoter comprises at least 1000 nucleotides.

92. The method of any one of embodiments 80 to 87, wherein said promoter comprises at least 2000 nucleotides.

93. The method of any one of embodiments 80 to 92, wherein said promoter comprises a nucleic acid sequence at least 85% identical to SEQ ID NO: 257.

94. The method of any one of embodiments 80 to 93, wherein said tobacco plant is selected from the group consisting a BU 64 plant, a CC 101 plant, a CC 200 plant, a CC 13 plant, a CC 27 plant, a CC 33 plant, a CC 35 plant, a CC 37 plant, a CC 65 plant, a CC 67 plant, a CC 301 plant, a CC 400 plant, a CC 500 plant, CC 600 plant, a CC 700 plant, a CC 800 plant, a CC 900 plant, a CC 1063 plant, a Coker 176 plant, a Coker 319 plant, a Coker 371 Gold plant, a Coker 48 plant, a CU 263 plant, a DF911 plant, a Galpão plant, a GL 26H plant, a GL 338 plant, a GL 350 plant, a GL 395 plant, a GL 600 plant, a GL 737 plant, a GL 939 plant, a GL 973 plant, a GF 157 plant, a GF 318 plant, an RJR 901 plant, an HB 04P plant, a K 149 plant, a K 326 plant, a K 346 plant, a K 358 plant, a K394 plant, a K 399 plant, a K 730 plant, an NC 196 plant, an NC 37NF plant, an NC 471 plant, an NC 55 plant, an NC 92 plant, an NC2326 plant, an NC 95 plant, an NC 925 plant, a PVH 1118 plant, a PVH 1452 plant, a PVH 2110 plant, a PVH 2254 plant, a PVH 2275 plant, a VA 116 plant, a VA 119 plant, a KDH 959 plant, a KT 200 plant, a KT204LC plant, a KY 10 plant, a KY 14 plant, a KY 160 plant, a KY 17 plant, a KY 171 plant, a KY 907 plant, a KY 907LC plant, a KTY14×L8 LC plant, a Little Crittenden plant, a McNair 373 plant, a McNair 944 plant, a male sterile KY 14×L8 plant, a Narrow Leaf Madole plant, a MS KY171 plant, a Narrow Leaf Madole (phph) plant, a MS Narrow Leaf Madole plant, a MS TND950 plant, a PD 7302LC plant, a PD 7305LC plant, a PD 7309LC plant, a PD 7312LC plant, a PD 7318LC plant, a PD 7319LC plant, a MSTKS 2002 plant, a TKF 2002 plant, a TKF 6400 plant, a TKF 4028 plant, a TKF 4024 plant, a KT206LC plant, a KT209LC plant, a KT210LC plant, a KT212LC plant, an NC 100 plant, an NC 102 plant, an NC 2000 plant, an NC 291 plant, an NC 297 plant, an NC 299 plant, an NC 3 plant, an NC 4 plant, an NC 5 plant, an NC 6 plant, an NC7 plant, an NC 606 plant, an NC 71 plant, an NC 72 plant, an NC 810 plant, an NC BH 129 plant, an NC 2002 plant, a Neal Smith Madole plant, an OXFORD 207 plant, a 'Perique' plant, a PVH03 plant, a PVH09 plant, a PVH19 plant, a PVH50 plant, a PVH51 plant, an R 610 plant, an R 630 plant, an R 7-11 plant, an R 7-12 plant, an RG 17 plant, an RG 81 plant, an RG H51 plant, an RGH 4 plant, an RGH 51 plant, an RS 1410 plant, a Speight 168 plant, a Speight 172 plant, a Speight 179 plant, a Speight 210 plant, a Speight 220 plant, a Speight 225 plant, a Speight 227 plant, a Speight 234 plant, a Speight G-28 plant, a Speight G-70 plant, a Speight H-6 plant, a Speight H20 plant, a Speight NF3 plant, a TI 1406 plant, a TI 1269 plant, a TN 86 plant, a TN86LC plant, a TN 90 plant, a TN90LC plant, a TN 97 plant, a TN97LC plant, a TN D94 plant, a TN D950 plant, a TR (Tom Rosson) Madole plant, a VA 309 plant, and a VA 359 plant.

95. The method of any one of embodiments 80 to 93, wherein said tobacco plant is selected from the group consisting of a flue-cured variety tobacco plant, a bright variety tobacco plant, a Burley variety tobacco plant, a Virginia variety tobacco plant, a Maryland variety tobacco plant, a Galpão variety tobacco plant, a dark variety tobacco plant, an Oriental variety tobacco plant, and a Turkish variety tobacco plant.

96. The method of any one of embodiments 80 to 95, wherein said tobacco plant is a hybrid tobacco plant.

97. The method of any one of embodiments 80 to 95, wherein said tobacco plant is a female sterile tobacco plant.

98. The method of any one of embodiments 80 to 97, wherein said tobacco plant is a male sterile tobacco plant.

99. The method of embodiment 95, wherein said male sterile tobacco plant is a cytoplasmically male sterile tobacco plant.

100. The method of any one of embodiments 80 to 99, wherein said axillary bud-degrading product is selected from the group consisting of a small RNA molecule and a polypeptide.

101. The method of embodiment 100, wherein said polypeptide comprises an amino acid sequence at least 70% identical or similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

102. The method of embodiment 100, wherein said small RNA molecule comprises at least 18 contiguous nucleotides identical or complementary to a polynucleotide selected from the group consisting of SEQ ID NOs: 83-101.

EXAMPLES

Example 1. Development of Tobacco Plants

An expression vector, p45-2-7 (SEQ ID NO: 112; FIG. 1), is used as a backbone to generate multiple transformation vectors. p45-2-7 contains a CsVMV promoter, a NOS terminator, and a cassette comprising a kanamycin selection marker (NPT II) operably linked to an Actin2 promoter and a NOS terminator. Nucleic acid vectors comprising transgenes of interest are introduced into tobacco leaf discs via *Agrobacterium* transformation. See, for example, Mayo et al., 2006, *Nat Protoc.* 1:1105-11 and Horsch et al., 1985, *Science* 227:1229-1231.

Narrow Leaf Madole (NLM) tobacco plants are grown in Magenta™ GA-7 boxes and leaf discs are cut and placed into Petri plates. *Agrobacterium tumefaciens* cells comprising a transformation vector are collected by centrifuging a 20 mL cell suspension in a 50 mL centrifuge tube at 3500 RPM for 10 minutes. The supernatant is removed and the *Agrobacterium tumefaciens* cell pellet is re-suspended in 40 mL liquid re-suspension medium. Tobacco leaves, avoiding the midrib, are cut into eight 0.6 cm discs with a #15 razor blade and placed upside down in a Petri plate. A thin layer of Murashige & Skoog (MS) with B5 vitamins liquid re-suspension medium is added to the Petri plate and the leaf discs are poked uniformly with a fine point needle. About 25 mL of the *Agrobacterium tumefaciens* suspension is added to the Petri plate and the leaf discs are incubated in the suspension for 10 minutes.

Leaf discs are transferred to co-cultivation Petri plates (½ MS medium) and discs are placed upside down in contact with filter paper overlaid on the co-cultivation TOM medium (MS medium with 20 g/L sucrose; 1 mg/L indole-3-acetic acid; and 2.5 mg/L 6-benzyl aminopurine (BAP)). The Petri plate is sealed with parafilm prior to incubation in dim light (60-80 mE/ms) with 18 hours on, 6 hours off photoperiods at 24 degrees Celsius for three days. After incubation, leaf discs are transferred to regeneration/selection TOM K medium Petri plates (TOM medium plus 300 mg/L kanamycin). Leaf discs are sub-cultured bi-weekly to fresh TOM K medium in dim light with 18 hours on, 6 hours off photoperiods at 24 degrees Celsius until shoots become excisable. Shoots from leaves are removed with forceps and inserted in MS basal medium with 100 mg/L kanamycin. Shoots on MS basal medium with 100 mg/L kanamycin are incubated at 24 degrees Celsius with 18 hours on, 6 hours off photoperiods with high intensity lighting (6080 mE/ms) to induce rooting.

When plantlets containing both shoots and roots grow large enough (e.g., reach approximately half the height of a Magenta™ GA-7 box), they are transferred to soil. Established seedlings are transferred to a greenhouse for further analysis and to set seed. Evaluation of suckering phenotypes is conducted by growing modified plants (T0, T1, T2, or later generations) and control plants to layby stage. Control plants are either NLM plants that have not been transformed or NLM plants that have been transformed with an empty p45-2-7 vector. Plants that have reached layby stage are manually topped (the shoot apical meristem and surrounding tissue is removed), and axillary bud growth is evaluated at specific time points after topping. Observations are typically performed at the time of topping (i.e., 0 hours), 24 hours (i.e., 1 day) after topping, 7-8 days after topping (i.e., one week), and/or 14-15 days (i.e., two weeks) after topping. Observations comprise qualitatively examining the presence or absence of axillary bud growth and overall plant appearance. Observations also comprise quantitatively measuring the fresh weight of all axillary buds at a specific time point after topping and/or measuring the length of all axillary bud outgrowths at a specific time point after topping.

Example 2. Expression Pattern of Axillary Bud-Preferred Promoters

Figure 2:
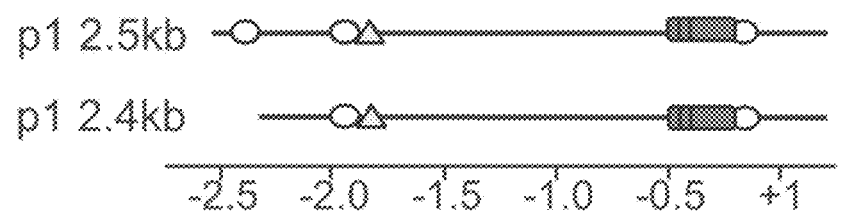
FIG. 2 depicts the location of the cis-regulatory elements Bud Dormancy Element (SEQ ID NO: 258), Sugar Repressive Element (SEQ ID NO: 259), and Axillary Bud Up2 Element (SEQ ID NO: 260) in the promoter sequences p1 2.5 kb (SEQ ID NO: 113) and p1 2.4 kb (SEQ ID NO: 257).

As noted in U.S. Patent Application Publication 2017/0260535, which is incorporated herein by reference, expression of axillary bud-degrading products can be better utilized to reduce or eliminate sucker outgrowth in modified plants if the axillary bud-degrading products are expressed in a tissue-dependent manner (e.g., only in the axillary bud). SEQ ID NO: 113 was previously identified as a promoter having axillary bud-preferred expression. See US 2017/0260535. The sequence of promoter P1 (SEQ ID NO: 113) comprises several cis-regulatory elements, including three sugar repressive elements, one axillary bud up2 element, and three bud dormancy elements. See FIG. 2 and Table 2. SEQ ID NO: 257 is identical to SEQ ID NO: 113, except for a 100 nucleotide deletion from the 5' end of the sequence, which includes a deletion of one sugar repressive element. See FIG. 2.

TABLE 2

Axillary bud-preferred promoter cis-elements

| Cis-regulatory element Name | Cis-regulatory element Nucleotide Sequence |
|---|---|
| Bud Dormancy Element | CACGTG (SEQ ID NO: 258) |
| Sugar Repressive Element | TTATCC (SEQ ID NO: 259) |
| Axillary Bud Growth Up2 Element | AAACCCTA (SEQ ID NO: 260) |

Expression patterns of SEQ ID NOs: 113 and 257 are analyzed by transformation of tobacco with a chimeric promoter::β-glucuronidase (GUS) reporter gene within the same plasmid backbone (p45-2-'7) described in Example 1. The chimeric gene is introduced via *Agrobacterium*-mediated transformation into an NLM line. GUS staining is used to identify tissue-specific promoter expression following the method of Crone et al., 2001, Plant Cell Environ. 24:869-874.

Briefly, tissue from young seedlings comprising a candidate promoter::GUS transformation construct is placed in cold 90% acetone on ice. When all samples are harvested, samples are placed at room temperature for 20 minutes. Samples are placed back on ice and acetone is removed from the samples. Next, staining buffer (0.2% Triton X-100; 50 mM NaHPO$_4$, pH7.2; 2 mM potassium ferrocyanide) is added to the samples. X-Gluc is added to the staining buffer to a final concentration of 2 mM. Staining buffer is removed from the samples and fresh staining buffer with X-Gluc is added. The samples are then infiltrated under vacuum, on ice, for 15 to 20 minutes. The samples are incubated at 37 degrees Celsius for 2-18 hours before the staining buffer is removed. Samples are washed through an ethanol series (i.e., 10%, 30%, 50%, 70%, 95%) in the dark for 30 minutes per wash. Finally, samples are transferred into 100% ethanol.

Figure 3:
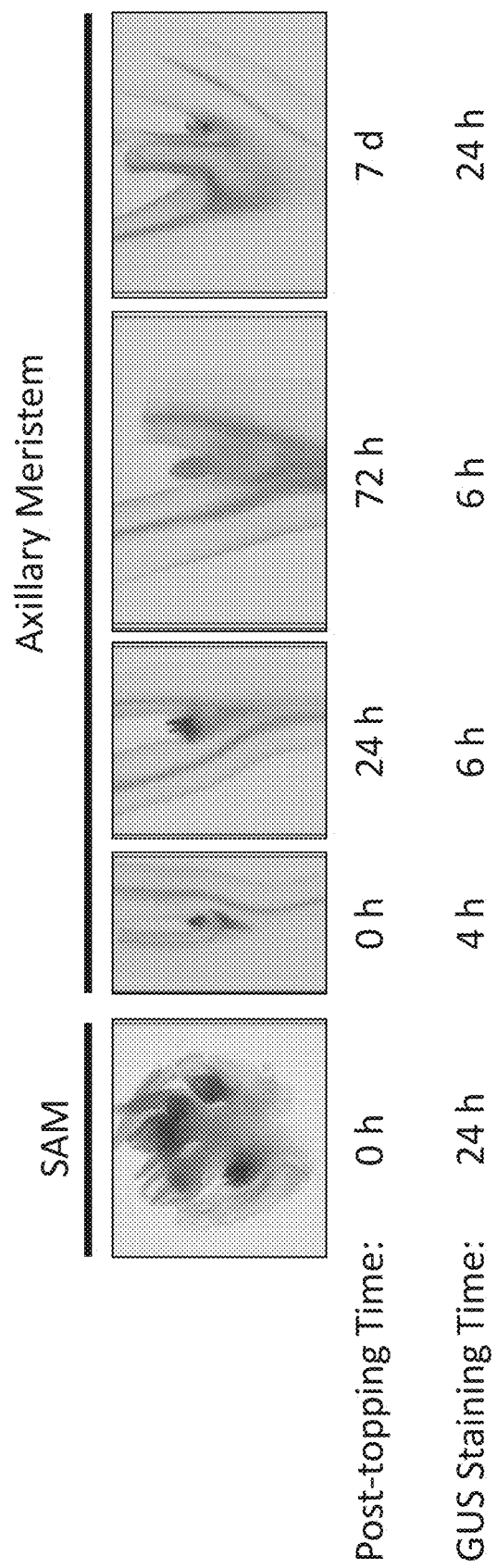
FIG. 3 shows the expression pattern of the promoter SEQ ID NO: 113 fused to 3-glucuronidase (GUS) in tobacco. Dark areas of GUS accumulation demonstrate where SEQ ID NO: 113 is active after topping. SEQ ID NO: 113 is not active in the shoot apical meristem (SAM) at the time of topping (0 h). However, SEQ ID NO: 113 is active in axillary meristems at the time of topping (0 h), 24 hours after topping (24 h), and 72 hours after topping (72 h). SEQ ID NO: 113 is not active seven days after topping (7 d). h=hours.
Figure 4:
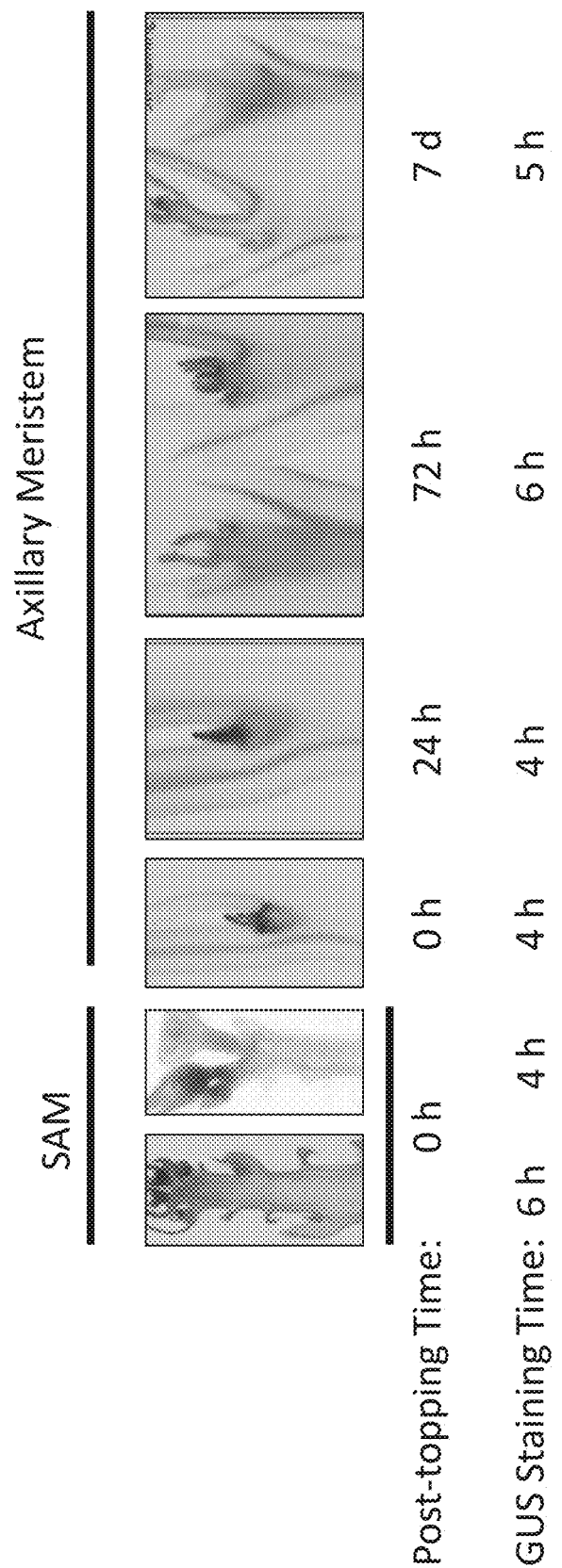
FIG. 4 shows the expression pattern of the promoter SEQ ID NO: 257 fused to GUS in tobacco. Dark areas of GUS accumulation demonstrate where SEQ ID NO: 257 is active after topping. SEQ ID NO: 257 is not active in the shoot apical meristem (SAM) at the time of topping (0 h). However, SEQ ID NO: 257 is active in axillary meristems at the time of topping (0 h), 24 hours after topping (24 h), 72 hours after topping (72 h), and seven days after topping (7 d). Panels 4A and 4B show different, independent tobacco lines comprising the SEQ ID NO: 257::GUS construct. h=hours.

GUS-positive plant tissues are examined with a brightfield microscope (Leica Q500MC; Cambridge, England) at a low magnification and photographed with a digital camera. Results of experiments using SEQ ID NOs: 113 and 257 are shown in FIGS. 3 and 4 respectively. Two independent modified lines are shown in FIG. 4 for SEQ ID NO: 257. These promoter sequences can be used to drive the expression of a sequence of interest exclusively, or predominantly, within an axillary bud while limiting expression in the rest of the plant.

Figure 5:
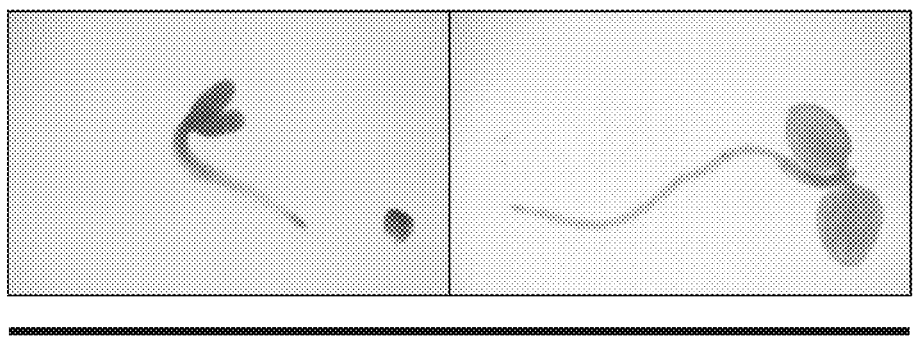
FIG. 5 shows the expression pattern of SEQ ID NO: 113::GUS and SEQ ID NO: 257::GUS constructs in tobacco seedlings. No GUS staining was detected with either construct.
Figure 5:
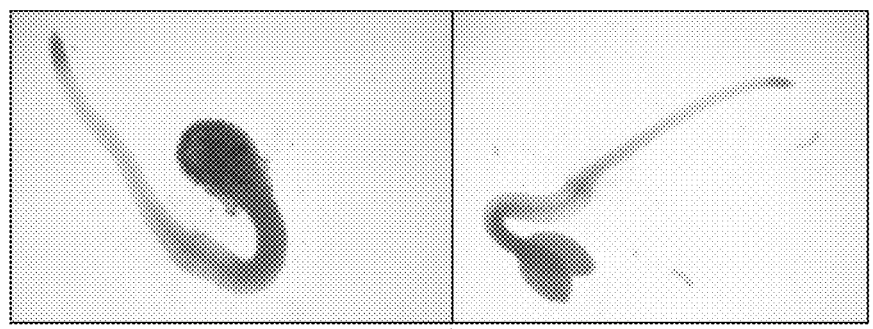
Figure 6:
FIG. 6 shows the expression pattern of SEQ ID NO: 113::GUS in the stigma, anther, and pollen grains of tobacco. No GUS staining was detected in any of these tissues.
Figure 6:
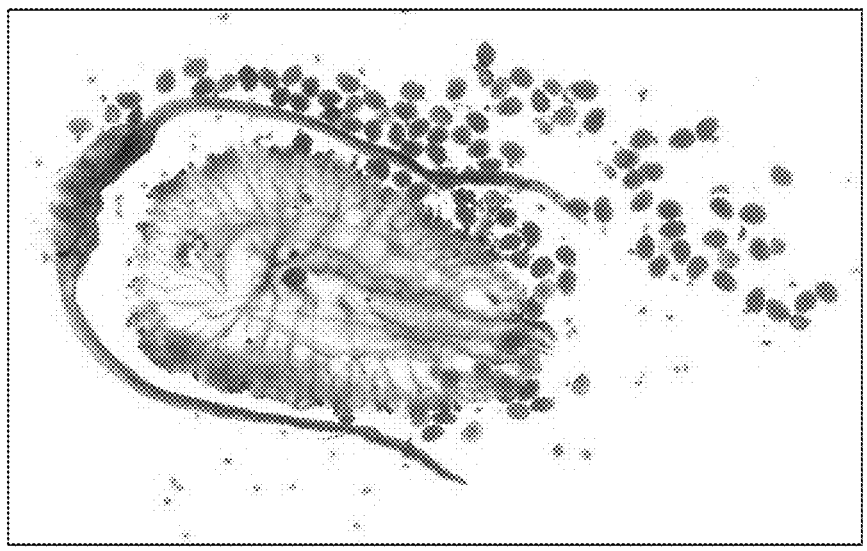

GUS-positive expression, indicating expression driven by SEQ ID NOs: 113 and 257, is concentrated in axillary buds. Neither promoter appears to be active in seedlings (FIG. 5), and SEQ ID NO: 113 is not active in stigmas or anthers (FIG. 6). The expression of GUS under the direction of SEQ ID NO: 113 decreases after topping, which coincides with the gene expression pattern that is observed for the endogenous genes that is normally regulated by these promoters. However, expression of GUS under the direction of SEQ ID NO: 257 is stronger and persists at a higher level for a greater period of time as compared to SEQ ID NO: 113. Notably, as shown in FIG. 3, little GUS expression is observed in axillary meristems seven days after topping when driven by SEQ ID NO: 113, even when stained for 24 hours. In contrast, both modified lines using SEQ ID NO: 257 to drive GUS expression still show strong activity seven days after topping, even when stained for only 5 to 7 hours (FIG. 4).

Example 3. Axillary Bud-Preferred Promoters Driving the Expression of Barnase

Two constructs were created as described in Examples 1 and 2, with either SEQ ID NO: 113 or SEQ ID NO: 257 driving the expression of Barnase (SEQ ID NO: 79). Tobacco plants were generated as described in Example 1.

Figure 7:
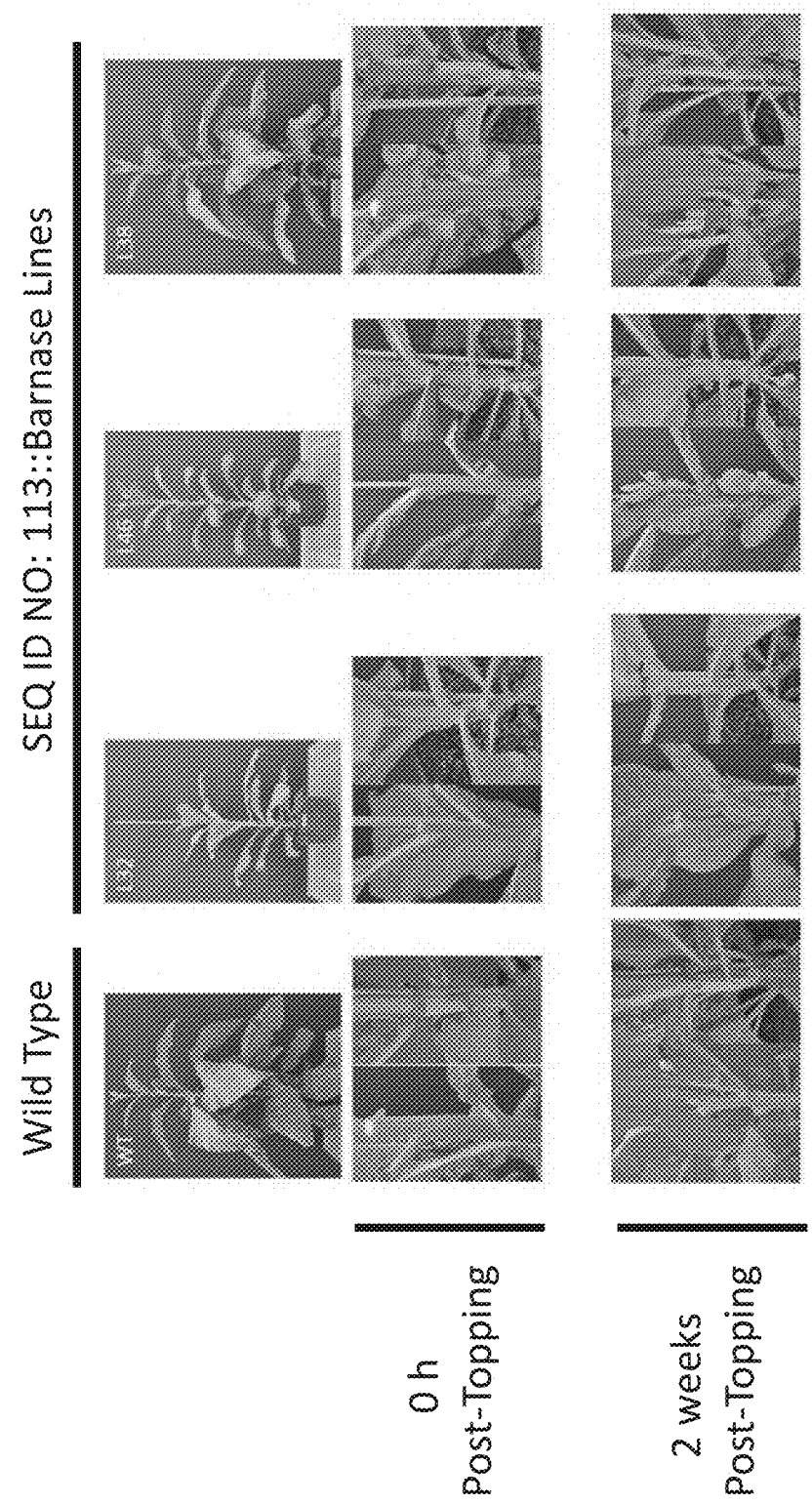
FIG. 7 shows photographs of wild type (control) tobacco plants and T0 tobacco plants from three independent tobacco lines comprising a SEQ ID NO: 113::Barnase (SEQ ID NO: 79) construct. The tobacco lines comprising the SEQ ID NO: 113::Barnase construct exhibit reduced suckering as compared to wild type two weeks post-topping. h=hours.

Tobacco plants (T0 generation) comprising SEQ ID NO: 113 driving the expression of Barnase and control tobacco plants are grown to the layby stage, then plants are topped to remove the shoot apical meristem. Sucker growth is observed at the time of topping and two weeks after topping (FIG. 7). Plants expressing the SEQ ID NO: 113::Barnase construct exhibit a reduction of suckers as compared to the control. However, the T1 generation seeds of SEQ ID NO: 113::Barnase lines exhibit poor germination, precluding further phenotypic analysis.

Figure 8:
FIG. 8 shows photographs of wild type (control) tobacco plants and T1 tobacco plants from one tobacco line comprising a SEQ ID NO: 257::Barnase (SEQ ID NO: 79) construct. Panel 8A shows the plants at the time of topping. Panel 8B shows the plants four weeks after topping. Plants comprising the SEQ ID NO: 257::Barnase construct exhibit reduced suckering as compared to the wild type plants.
Figure 8:
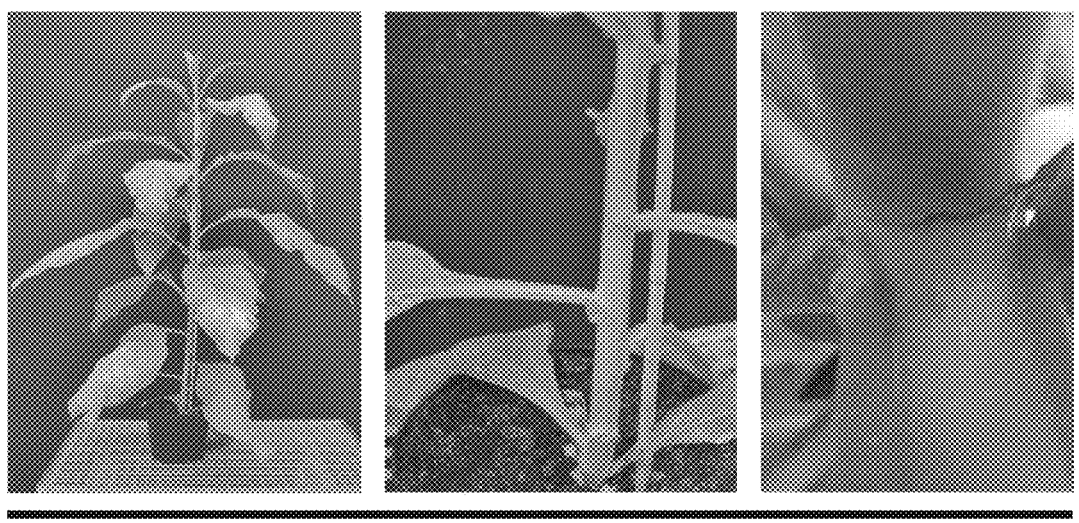
Figure 8:
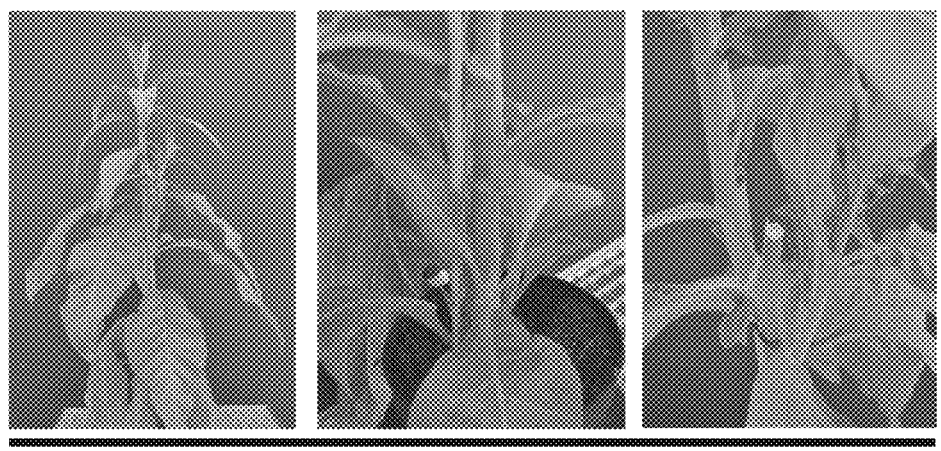
Figure 8:

In contrast, T1 generation seed comprising SEQ ID NO: 257 driving the expression of Barnase exhibit good germination. Tobacco plants (T1 generation) comprising SEQ ID NO: 257 driving the expression of Barnase and control tobacco plants are grown to the layby stage, then plants are topped to remove the shoot apical meristem. Sucker grown is observed at the time of topping and four weeks after topping (FIG. 8). Plants expressing the SEQ ID NO: 257::Barnase construct exhibit a reduction in suckers as compared to the control. Modified plants comprising the SEQ ID NO: 257::Barnase construct demonstrate superior reduction of suckers and superior T1 seed germination as compared to modified plants comprising the SEQ ID NO: 113::Barnase construct.

SEQUENCE LISTING (260 sequences)

SEQ ID NO: 1 - DNA, 987 bp, Artificial Sequence
  Description of Artificial Sequence: Synthetic polynucleotide
atgtatccgccaagcaacagctgcaactacagccccattttcaacatcccttctccttgtatgcaatatggagacgaactattcttccaatattatcctgaccatttccttcaacagcaacaagtgcctttgatagaagatcagagtgttgacatcttagctgattgcactgagaatgttactaacgaagaaactgtcatcaatactgatactgtaaaagttctttatgacacaggagctgttacaaacagtcagtgttggggaggaaatgaagaagtagaagaaggccgcgaaaacaaaagaaatgacatgagaagcaccattagtattattcatgtacggaaaaacaagaaatgttccaataaagatcgacatagcaagattaacactgctcgtggcctcagagaccgaaggatgagactttcccttgatgcagctcgcaagtttttcagtttacaagacatgttggggttcgataaggcaagtaaaactgtagaatggttgcttatcaaatcggagtctgaaatcgaagagctagccaaaggcaataaaggaggaggcattcctaaacaaagctgcagtactactaatggaattggtgcaattagtactgcaatatcctctatttctgagtgtgaggttatatcaggaactgatgaatctttctctattacttataaaaagaagctgaaaactgctaaaggagcctcgaaaaagacggctaaaactgctcgtagagctgcatttgatcgtcttattacaagggaaacgaggaatcaagcaagggctagggctagagagagaacaaaaataaagaaaagcctcggtaaatccaaagagaacagtgctgattactgtaatttggtggataattatggagattggagtcaatttagtatcttcaactatcagaaaaatgcagttggaatttcccatgatcaggtgggttcaataattaaacaacatgattttttaggatttcaatag

SEQ ID NO: 2 - protein, 328 aa, Artificial Sequence
  Description of Artificial Sequence: Synthetic polypeptide
MYPPSNSCNYSPIFNIPSPCMQYGDELFFQYYPDHFLQQQQVPLIEDQSVDILADCTENVTNEETVINTDTVKVLYDTGAVTNSQCWGGNEEVEEGRENKRNDMRSTISIIHVRKNKKCSNKDRHSKINTARGLRDRRMRLSLDAARKFFSLQDMLGFDKASKTVEWLLIKSESEIEELAKGNKGGGIPKQSCSTTNGIGAISTAISSISECEVISGTDESFSITYKKKLKTAKGASKKTAKTARRAAFDRLITRETRNQARARARERTKIKKSLGKSKENSADYCNLVDNYGDWSQFSIFNYQKNAVGISHDQVGSIIKQHDFLGFQ

SEQ ID NO: 3 - DNA, 318 bp, Artificial Sequence
  Description of Artificial Sequence: Synthetic polynucleotide
atggctcgctccttgtgtttcatggcatttgcagtcttggcaatgatgctctttgttgcctatgaggttcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgttcgatgagaagatgatcaaaacaggagctgaaacttttgctgaggaagcaaaaactttggctgcagctttgcttgaagaagagataatggataactaa

SEQ ID NO: 4 - protein, 105 aa, Artificial Sequence
  Description of Artificial Sequence: Synthetic polypeptide
MARSLCFMAFAVLAMMLFVAYEVQARECKTESNTFPGLCITKPPCRKACISEGFTDGHCSKILRRCLCTKPCVFDEKMIKTGAETFAEEAKTLAAALLEEEIMDN

SEQ ID NO: 5 - DNA, 1797 bp, Artificial Sequence
  Description of Artificial Sequence: Synthetic polynucleotide
atggcttctcttccccttctcaccaccaatgccatctcttcatcagcttcttctttaaccaccacacctctttccaatttgcattcttctcctttctttacaaagacatcaaaagtttccactatagataagtgcagtaactatcgtttccaagtttcatgcaagggtacagaagatgaccaaaccatcaacacttccaaatcttctgattcttcaaacaataagatcattgatagaagaaacatgctacttggattaggaggcatttatggtgctgctactcttgttggtggtcatccctttgccttcgcggctcctgtgcccggacctgacgtttccaaatgtggtcctgcagatttgccaccaggtgcagcaccagtcaactgttgtcctccgacaacggcgaacatcatcgacttccaacttccaccaccgtcaaccaccctccgtacacggccagcagctcattccgccgatagtgcctatatagagaaattcaacagagctattcagctcatgaaacaacttccagataacgatccacgtagcttcaagcaacaagcaaatgttcattgtgcttactgtgatggagcttatggacaactaggtttcccaagttctgaactccaagttcattcctcttggcttttcttccctttccatcgttgttatctctacttcttcgaaaaaatcttgggaagtttaataaatgaccctactttcgctatcccattttggaactgggatcatcctgatggcatgagacttccggccatgtatgcgaaccgtagttcttctctcttcgatcctctccgtgatcagaagcatcagcctccggtcattgttgatctcgacttcaatggagcggatcctaacataagtaacgctcaacaaacttcccagaatctgacaatcatgtataggcaaatggtctctctaggaagtactccggcagctttcctcggagacccttaccgtgccggtggcgaaccgggtggtgctgggtccctcgagaacattccacatggaacggtccatgtttggaccggtgatagaacccaacctaattttgaaaatatgggagttttttatgcagctggtagagaccctattttctatgctcatcattctaatattgatagattgtggagtgtttggaaaaccctaggtggaagacgtcaagattttactgaccctgattttttaaattcttcgtttttgttttacgatgagaaagcacaaatggtacgtattagggtacgtgactgtttggatacaacaagacttggatacgtttatcaaggtgtagttaatccgtggataaattctcgtccaagggctagggtttcaagtgctttgagtagcgtaaggaggcttgctgaagcaaaagattatttcccaacaaaacttggccatgtgataagagtaatggtgaaaaggccaaataataaaaagagaaacaaggaggagaaagatgcaaaagaggagtttttagtggttgaagggatagagctggaaactgatgtttttgtcaagtttgatgtgttgattaatgatgaagatgagactgtaatttcgccgaataatgctgagtttgcaggtagttttgtgaacgtgccacatcttagtcatggtaagagtgacgagaaacgtaagactaagttgaagttggctataactgagctgctggaagatttagatgctgaggatgatgatcatgtggtggtgacttttgttccaaagaatggttctggtgctgtgaaaattggaggtgtcaagattgtgcttgaggattga

SEQ ID NO: 6 - protein, 598 aa, Artificial Sequence
  Description of Artificial Sequence: Synthetic polypeptide
MASLPLLTTNAISSSASSLTTTPLSNLHSSPFFTKTSKVSTIDKCSNYRFQVSCKGTEDDQTINTSKSSDSSNNKIIDRRNMLLGLGGIYGAATLVGGHPFAFAAPVPGPDVSKCGPADLPPGAAPVNCCPPTTANIIDFQLPPPSTTLRTRPAAHSADSAYIEKFNRAIQLMKQLPDNDPRSFKQQANVHCAYCDGAYGQLGFPSSELQVHSSWLFFPFHRCYLYFFEKILGSLINDPTFAIPFWNWDHPDGMRLPAMYANRSSSLFDPLRDQKHQPPVIVDLDFNGADPNISNAQQTSQNLTIMYRQMVSLGSTPAAFLGDPYRAGGEPGGAGSLENIPHGTVHVWTGDRTQPNFENMGVFYAAGRDPIFYAHHSNIDRLWSVWKTLGGRRQDFTDPDFLNSSFLFYDEKAQMVRIRVRDCLDTTRLGYVYQGVVNPWINSRPRARVSSALSSVRRLAEAKDYFPTKLGHVIRVMVKRPNNKKRNKEEKDAKEEFLVVEGIELETDVFVKFDVLINDEDETVISPNNAEFAGSFVNVPHLSHGKSDEKRKTKLKLAITELLEDLDAEDDDHVVVTFVPKNGSGAVKIGGVKIVLED

SEQ ID NO: 7 - DNA, 1392 bp, Artificial Sequence
  Description of Artificial Sequence: Synthetic polynucleotide
atggtaggcaaaagaaatgagcctcatgtcatatttgtaccttacccaagccaaggtcacattaaccctcttctccaatttgcaaaacgcttatactccaaaggtgtaaaagcaactttagccactactaaatacacagtcaagtctattaattcacccaacatttcagttgaagcaatttctgatggatttgacgaaagtggtttttcccaagcccaaaaagcagatatatatctcaaatcattcaaagaaaatggttcaacaactctatcagaaataataaaaaattacgagaattcgacacatccgataagttgcattgtttatgattcgtttttaccatgggctcttgatgtggctaaaaaacatgggatttatggagctgcgttttttacaaattcagccactgtttgtgtagtttttgctcacattcattataaaacattttcattgccggcgaagattgaagaaaatgagccattgttattgcctggattgcctagtttgtacccaattgatgttcctggatttattagggagcctgaaagttaccctgcttacttagccatgaaaatgagtcaattctctaatttggaaaatgctgattgggtttttgataactcctttcaagaactagaaggagagatagcaagtggagtttcaaatatttggccagcaaggttaattggaccaatggtgccatcatcctatttagatgacataatagaaggtgacaaagggtacggagcaagtctatggaaaccacttagtgaagaatgtctcaaatggctaaaaacaaagccaaatcaatcagtaatctacatttcttttggcagcatggtatcactcacaccacaacaaatggaagaaatggcaaatgctttaatagacagcaacatgaatttcctttgggttgtaagagaaaccgaaaaaggcaaattgccaaaaaaattcatagaatccacaattggaaaagggttaattgtgtcatggtgcaatcaattagaaatgctagcaaatcaagccattggttgttttgtgactcattgtggatggaattcgactcttgaaggattgagccttggcgtgccaatggtggcaatgccacaatggtctgatcaaatgacggatgctaaatttataggtgagatttgggaaattggtgtgaggcctaagttggataagtttgggattgttagaagagaagagctattgttttgtttaaaggaagtaatgggagggaagaggagttatgagattaggagaaatgctggaaaatggaagaacttggctaagaaagcaattagtgaaggaggtagctcggacaagtctattaatgtatttgtgaacagtcttagtctagcatgccagatgaagaagtacaagaaataa

SEQ ID NO: 8 - protein, 463 aa, Artificial Sequence
  Description of Artificial Sequence: Synthetic polypeptide
MVGKRNEPHVIFVPYPSQGHINPLLQFAKRLYSKGVKATLATTKYTVKSINSPNISVEAISDGFDESGFSQAQKADIYLKSFKENGSTTLSEIIKNYENSTHPISCIVYDSFLPWALDVAKKHGIYGAAFFTNSATVCVVFAHIHYKTFSLPAKIEENEPLLLPGLPSLYPIDVPGFIREPESYPAYLAMKMSQFSNLENADWVFDNSFQELEGEIASGVSNIWPARLIGPMVPSSYLDDIIEGDKGYGASLWKPLSEECLKWLKTKPNQSVIYISFGSMVSLTPQQMEEMANALIDSNMNFLWVVRETEKGKLPKKFIESTIGKGLIVSWCNQLEMLANQAIGCFVTHCGWNSTLEGLSLGVPMVAMPQWSDQMTDAKFIGEIWEIGVRPKLDKFGIVRREELLFCLKEVMGGKRSYEIRRNAGKWKNLAKKAISEGGSSDKSINVFVNSLSLACQMKKYKK

SEQ ID NO: 9 - DNA, 405 bp, Artificial Sequence
  Description of Artificial Sequence: Synthetic polynucleotide
atggcagggaaggttgagaaagtgcttgcagtagtgatgcttgcaatgcttctgttttcggagcatttaatggctgctaatcatgaaattaaaacaactgaagataactctactattagccctttctgcttagtaaaatgtttatttggatgtagggggttgccacctgtacaagcatccatttgtgctgctcaatgttatttaaagtgccgtgaccaagatgcggccaatattgctgaaactaagggcataattggtgagactgcatacaaccagtatgatgttggatgtgcccttggctactgctctgagttcctgttgaattatgatgagaagaggttcaagtgctgcatggaatactgccgcgaggacaaaatgatttgtcctgttgaggctgcagcttga

SEQ ID NO: 10 - protein, 134 aa, Artificial Sequence
  Description of Artificial Sequence: Synthetic polypeptide
MAGKVEKVLAVVMLAMLLFSEHLMAANHEIKTTEDNSTISPFCLVKCLFGCRGLPPVQASICAAQCYLKCRDQDAANIAETKGIIGETAYNQYDVGCALGYCSEFLLNYDEKRFKCCMEYCREDKMICPVEAAA

SEQ ID NO: 11 - DNA, 630 bp, Artificial Sequence
  Description of Artificial Sequence: Synthetic polynucleotide
atgaattcaaagaaaaacaactcaccaagaaaaaggttgagaaaatatcatacaagaaaagctcctattattagctcttatatggacatggctgaagctagaagagaaattgttcatgctttacaacttcatcgatcttcatcttcatctccaactccgtctattaatagcccaaagaagtacacattattgggtcaaggagttgtaagctctcaacaatattactattactcaatagtggaatctatgcctattcctgaaccaacatggtctacaacggctccggcaatacttaatgcactgccaccgctgccgctgccgctgccgccacctccgccgctgtcttcttcttccggtgaagttccagagtttgaatggtggatagggtttttgaagtcgttggacggcaagaagagtgctaacaatggtgaagtagtcatagaaaaatattttcctctagaagaaaatgttttgatggaaaattcaaagacaggttttggtcaattagaacatggattaaacagtgagtctcctaattgtatagataagaatgatgatcctaattaccaatttccagatgagtggttgattatccctacagctgatgatgattatgtacttgagctttaa

SEQ ID NO: 12 - protein, 209 aa, Artificial Sequence
  Description of Artificial Sequence: Synthetic polypeptide
MNSKKNNSPRKRLRKYHTRKAPIISSYMDMAEARREIVHALQLHRSSSSSPTPSINSPKKYTLLGQGVVSSQQYYYYSIVESMPIPEPTWSTTAPAILNALPPLPLPLPPPPPLSSSSGEVPEFEWWIGFLKSLDGKKSANNGEVVIEKYFPLEENVLMENSKTGFGQLEHGLNSESPNCIDKNDDPNYQFPDEWLIIPTADDDYVLEL

SEQ ID NO: 13 - DNA, 1143 bp, Artificial Sequence
  Description of Artificial Sequence: Synthetic polynucleotide
atgtatccgtcaagcaacagctgtaattacagcctcaatatttcctcctcaaataacttatttcacattccatctccgaattctatgcaatatgaacacgaacttttccaatattttcatgaccatcatctccttcaaccccaacaacaacaacaacaacaacaactcttgactacacctgatcattatatggcagcagattccaacaaagacaccgtaatcagtagtactaatcaagatcctgaagaagttgaattacaaggccgctgcaagaacaaaaaaggtgacaataagagacgtgttgcttacaagaaagatagacacagcaagattaacactgctcacggccctagagaccgaagaatgagactttctctcgatgtagctcgcaaatttttcaatttgcaagacttgcttggattcgataaggctagcaaaactgtggagtggttgctaacaaagtccaaatgtgctgtcaatgagctcgtccaaggcataaataaagaaaattgcgctactgctaatattggtgcaattagtacatgctctactacatctgagtgtgaagttgtatcaggaattgatgaatctacaaccactaatgatattcagaagcagtcaaatagaggtaaagtaggggagaagaagaaggctaataaactagttcgtagagctgcatttaatcctgtggcaaaggaatcaagaaagcaagctagagcgagggcaagggagagaacaaaaataaagaaaagctttttaaatattggtgatcagtctatggcggctgatgatttaaaacgattaggatgttggagtctttttgaaacaggtgaagaatcaggtattcaaggtactaatcatcaaattgaagaacacaccacgcaccacgaggagcctcttttggggactaatgagaatgttgatgattgtaatttggttgttaccggcaactggaacccatataccatcttcaattatcaccacagtactgaaatttctcacgaggtaggttttacacttcatttaaatccaagagtaattcttttagagttcaagattctgatattttttttggtggcgagaccctttcttatatcaaagcaaccttcaaggtacatacaagattggataaaccaattctga

SEQ ID NO: 14 - protein, 380 aa, Artificial Sequence
  Description of Artificial Sequence: Synthetic polypeptide
MYPSSNSCNYSLNISSSNNLFHIPSPNSMQYEHELFQYFHDHHLLQPQQQQQQQQLLTTPDHYMAADSNKDTVISSTNQDPEEVELQGRCKNKKGDNKRRVAYKKDRHSKINTAHGPRDRRMRLSLDVARKFFNLQDLLGFDKASKTVEWLLTKSKCAVNELVQGINKENCATANIGAISTCSTTSECEVVSGIDESTTTNDIQKQSNRGKVGEKKKANKLVRRAAFNPVAKESRKQARARARERTKIKKSFLNIGDQSMAADDLKRLGCWSLFETGEESGIQGTNHQIEEHTTHHEEPLLGTNENVDDCNLVVTGNWNPYTIFNYHHSTEISHEVGFTLHLNPRVILLEFKILIFFLVARPFLISKQPSRYIQDWINQF

SEQ ID NO: 15 - DNA, 915 bp, Artificial Sequence
  Description of Artificial Sequence: Synthetic polynucleotide
atggaaaaggttcatgagaaaccgctatctctttataatggatcattatctgtttttagattaggagatttggctgtgaaaataacaaaggtgaaaaagggatcattaaataatgataatctttcacccccaacttcattgttagttgtttcaccaatcataccaggaacttatccagttttactcttttttcatggcttcgttctcaagcctatatggtacaagtctctccttcaacatatttcttcccacggctatatagttgttgctccacaggtttctcaaagcgaagaagtgaaaaaagcagccaaagttacagaatggttaagtaaagccctcgaatccgtactgccggagaaagtacagccggatctactccagctcgccgtctccggccacagcagaggtggtaaaatagcatttgcactagctttaggatatggcatcaaatttcaagcacttctaggaattgatccagttgcaggtttttctccgtccaaccgatctgctccaaaaattcttaaatatattcctcgtattttcgatcagacggtccctgtggcggtgatcggcgctggcttgtcaaaccaaagtgcgaattgtatctttccacccttcgcaccaaacggtgtcaaccattcggagttttttaacgagtccaaaccaccttgctgttattttctggctaaaaattatggacatactgatatgttagatgacagaattgctgcaattgcgagttggatttcaaagagtgggaagggacccaaggaccttatgagaaaggctgttggagggattgttgtggcttttcttgaggctaaattgggagagaaagtggataatctaaatgccattgttcaagaaccttctcttgctcccatcatccttgacccagtcatatctgtcaaataa

SEQ ID NO: 16 - protein, 304 aa, Artificial Sequence
  Description of Artificial Sequence: Synthetic polypeptide
MEKVHEKPLSLYNGSLSVFRLGDLAVKITKVKKGSLNNDNLSPPTSLLVVSPIIPGTYPVLLFFHGFVLKPIWYKSLLQHISSHGYIVVAPQVSQSEEVKKAAKVTEWLSKALESVLPEKVQPDLLQLAVSGHSRGGKIAFALALGYGIKFQALLGIDPVAGFSPSNRSAPKILKYIPRIFDQTVPVAVIGAGLSNQSANCIFPPFAPNGVNHSEFFNESKPPCCYFLAKNYGHTDMLDDRIAAIASWISKSGKGPKDLMRKAVGGIVVAFLEAKLGEKVDNLNAIVQEPSLAPIILDPVISVK

SEQ ID NO: 17 - DNA, 1353 bp, Artificial Sequence
  Description of Artificial Sequence: Synthetic polynucleotide
atgtgtttgttaataaaggtggcgaatccaggagaatccggcgagcatgacagaattccatcaacgggaggtgattcagaaagtacaactactaccacagaaggaggaattccgcagctatatgaacaattacaatcacaatcacaatcatttgaagaaatgttgcggcaacaaatacaacaagaaacagagtatttgatgtcttcatctgcaactcctatgttttcacggtatagtcagacaagggagatgtcggcaatggtaacggcgttaacgcatgtggtatcaggacggagagagggagagtggacttacaggccggatattagtgccggcgctgttacgacgtcgtttgctggtggttcgagtatttattcggcgagttcgccgtcgtcttcaagttcagggtcatgggctggacagaagagaagacgtgatcaagaagaaagtgttgctgcagagcaagttcaaagggtttatggagcttttggtgaatttagaggtggagaatcatcttcctctgttaaaactgaagaagcttcaagcatggtagcaccaccaaccaccaccagcactaccaccacaaccaccacggcggcgcaaacaccaccagaaccagcggaaggaggaggagctgaagaaacaggggaaaggaggaggagatacagaggagtaagacaaaggccatggggaaaatgggcagcagaaataagagatccacacaaagcagctagagtttggttaggcacatttgatacagctgaagctgctgctagagcttatgatgaagctgcccttagattcagaggaaacagagctaaactcaatttccccgaaaatgtccgcatattaccacaacaacaacagcaacaacctcaagccacaacaagatcagccatttccagctcctccgcagcttcacaattcccattaatggctgcagcaacaactccatcaccatttttccaaacttatcaacctcagcagcagcagctgccttttcagagttcagaaatggttagagattattgggaatactcacagttacttcaaaatccaggagagtttcatttacaacaacagccttcagccttgttagagcaaatgttgtttgcttcttcatcaatgggtcttttgcaatcacacacattcccttcttattcttcatcttcctcattagctacttcctctgcagcttcttcccctgcatatcccctgttttactctgctcaacaatcacgtttctttcagcccccacaaagtactcatcaaaatcaaactagtagcagcagctccagttttcctgcaccattttggactagttcaacccactacccaccttcttctagttaa

SEQ ID NO: 18 - protein, 450 aa, Artificial Sequence
  Description of Artificial Sequence: Synthetic polypeptide
MCLLIKVANPGESGEHDRIPSTGGDSESTTTTTEGGIPQLYEQLQSQSQSFEEMLRQQIQQETEYLMSSSATPMFSRYSQTREMSAMVTALTHVVSGRREGEWTYRPDISAGAVTTSFAGGSSIYSASSPSSSSSGSWAGQKRRRDQEESVAAEQVQRVYGAFGEFRGGESSSSVKTEEASSMVAPPTTTSTTTTTTTAAQTPPEPAEGGGAEETGERRRRYRGVRQRPWGKWAAEIRDPHKAARVWLGTFDTAEAAARAYDEAALRFRGNRAKLNFPENVRILPQQQQQQPQATTRSAISSSSAASQFPLMAAATTPSPFFQTYQPQQQQLPFQSSEMVRDYWEYSQLLQNPGEFHLQQQPSALLEQMLFASSSMGLLQSHTFPSYSSSSSLATSSAASSPAYPLFYSAQQSRFFQPPQSTHQNQTSSSSSSFPAPFWTSSTHYPPSSS

SEQ ID NO: 19 - DNA, 732 bp, Artificial Sequence
  Description of Artificial Sequence: Synthetic polynucleotide
atggcacatttcttctctataaattcaacgttagcaggaacgaataaagcatccaaaacaaatttcacatattcaactcaagaaacagaaaaaccaaaaataaagatcatcttactcttgttttctcttgcattagttcccttgtcagcgatggcaacttgcaccactgatactccaaaccaagcactattgagggatgtacacgatatagatggtaacccccttcaagtaaaagccaggtacttcatatttccagttattggcggtggtggtgtacggcttgctaatcttggagatcaagacgaaaacgcttgtgccacagcggtggtgctatcacgcagtgaagttgacaaaggtaaagcagtcaacttcatacctaaagaccccaaacatgagaagattgtggaggcctcttcagtaaacatccagttttatcttgattattataagtgtgctaacctaactgtgtggaaagtagacaactaccctacacttccaagtcgctacaccataagcacaggtgcaacgccgggaaatcccctagagttgaatagctggtttcaaattatgtctcttggtggctcgacgtataagatagtcttctgtccctttggagaatgccaaaatgttggcattgccgaggaaaatggatataatcgtttggttctcgcagagaatgcaaaggcctttgttttcataaagcaaggcggatatggaaaggccgaagcatga

SEQ ID NO: 20 - protein, 243 aa, Artificial Sequence
  Description of Artificial Sequence: Synthetic polypeptide
MAHFFSINSTLAGTNKASKTNFTYSTQETEKPKIKIILLLFSLALVPLSAMATCTTDTPNQALLRDVHDIDGNPLQVKARYFIFPVIGGGGVRLANLGDQDENACATAVVLSRSEVDKGKAVNFIPKDPKHEKIVEASSVNIQFYLDYYKCANLTVWKVDNYPTLPSRYTISTGATPGNPLELNSWFQIMSLGGSTYKIVFCPFGECQNVGIAEENGYNRLVLAENAKAFVFIKQGGYGKAEA

SEQ ID NO: 21 - DNA, 471 bp, Artificial Sequence
  Description of Artificial Sequence: Synthetic polynucleotide
atggctgagcaacaccagcgccaccagcaacagcagcagcagcagcagatgcaagtgggccacccgacggaggcaatcaagagccttcttcctcaaaggggtccctctaaatcccaagtccttgctgtcgtcactctcttccctgttggtggggccctcctctgccttgctggactgacgctcgccggaactctgatcgggcttgcagtcgctacgccggttttcttactgttcagcccggttttggtccccgctgccctgacaatcgcgttggccgtcactggattcttgacttccggcgcctttggaataacggcgctgtcgtcgctctcgtggatcattaactatatgaggagaatcacaggtccagcagcagagcagatggagcatgcaaagcggagggtgcaggacactgctggtcatatgggacagagaggtggacagaagattcaagaaactgctagaacttga

SEQ ID NO: 22 - protein, 156 aa, Artificial Sequence
  Description of Artificial Sequence: Synthetic polypeptide
MAEQHQRHQQQQQQQQMQVGHPTEAIKSLLPQRGPSKSQVLAVVTLFPVGGALLCLAGLTLAGTLIGLAVATPVFLLFSPVLVPAALTIALAVTGFLTSGAFGITALSSLSWIINYMRRITGPAAEQMEHAKRRVQDTAGHMGQRGGQKIQETART

SEQ ID NO: 23 - DNA, 1437 bp, Artificial Sequence
  Description of Artificial Sequence: Synthetic polynucleotide
atggatagtgataggagggattgccacttgaacatgttgtccaaaatggctatgtgcaaatcacacgggcaagactcttcctatttcataggatggcaagaatatgagaagaacccttatcatcccattcaaaatccttctggtattattcagatgggtcttgctgagaatcagctctcattcgatcttcttgaatcatggctcacaagaaaccaagatgtaatccagtttagagaaaatggaggatctatgttcagagacttggctcttttccaagattatcatggattgcaggctttcaagaacgtactagtgtcattcatgggtgagatcagaagaaggaaagtaaaatttgatccagagaagctagtactcacagctggttcaacttcagcaaacgaaaccctcatattttgcttagctgaacctggagaagctctccttcttccaactccttattatccagggtttgatagagatctaaaatggagaacaggggctgaaattgtacccatacactgctacagttcaaataacttcagaataactgagtctgcccttgaagatgcatatgaagaagcccaacgacttaatttaagagtcaagggtgtatttatcacaaatccttcaaatccactagggacaaccatgtcacgagacgaattaaacaatcttatcacctttgccatggccaaaaatattcatatagttagcgacgaaatatacgctggaacagttttcgattcgccaaaattcataagcataatggaagctttaattgacagaaaacatgaaaaatccaaaatgtggagtcaagttcacattgtgtcaagtctatcaaaagatctaggtctaccaggtttcagaattgggatgatttattcaaacaatgaaactcttatagctgctgctacaaaaatgtcaagttttggactcatttcatctcaaactcagtatctactatctaaaattcttggagataaaaaatttataaaacgttacattaaagaaaacaagaaaggattgaaaaagaggagggaaatgcttgtttccgggttagagaatagtgggattgagtgtttgaaaagtaatgctggattattttgttttgtggacatgaggcatttgctaaattcaaacacatttgaagcagaaatggaactgtggagaaaaatactactaagtgatgttggtttaaatgtgtctcctggatcttcttgtcactgtagtgaacctggttggtttaaaatttgttttgcaaatattgccgaagaaactcttgatctcgcgatgcagaggattaatgattttgtcagttctatgaatcttcaacggcgacagctgatcgcggcggcgtcggcgtctagctcaaggaggaggacacttgcgaactgggttgttaagttatcttcaggtgaaggaaaaacatatcgttaa

SEQ ID NO: 24 - protein, 478 aa, Artificial Sequence
  Description of Artificial Sequence: Synthetic polypeptide
MDSDRRDCHLNMLSKMAMCKSHGQDSSYFIGWQEYEKNPYHPIQNPSGIIQMGLAENQLSFDLLESWLTRNQDVIQFRENGGSMFRDLALFQDYHGLQAFKNVLVSFMGEIRRRKVKFDPEKLVLTAGSTSANETLIFCLAEPGEALLLPTPYYPGFDRDLKWRTGAEIVPIHCYSSNNFRITESALEDAYEEAQRLNLRVKGVFITNPSNPLGTTMSRDELNNLITFAMAKNIHIVSDEIYAGTVFDSPKFISIMEALIDRKHEKSKMWSQVHIVSSLSKDLGLPGFRIGMIYSNNETLIAAATKMSSFGLISSQTQYLLSKILGDKKFIKRYIKENKKGLKKRREMLVSGLENSGIECLKSNAGLFCFVDMRHLLNSNTFEAEMELWRKILLSDVGLNVSPGSSCHCSEPGWFKICFANIAEETLDLAMQRINDFVSSMNLQRRQLIAAASASSSRRRTLANWVVKLSSGEGKTYR

SEQ ID NO: 25 - DNA, 645 bp, Artificial Sequence
  Description of Artificial Sequence: Synthetic polynucleotide
atgaacggtggttcatgtggtggtgctgatcgtgagtataataacaataacaacaataatgttgtaggtggaggaggtggcgggccttgtggtgcatgcaagtttcttagaagaaaatgtgtgaggggatgcatatttgcaccttattttgattctgatcaaggcactgctcatttcgctgctgtacataaggtgtttggtgctagcaatgcctctaaattgctgctcagaattccagcgcataaacgtctggatgctgtcgttacactttgctatgaggctcttgctagagttagagaccctatctatggttgtgttgctcacatctttactcttcagcaacaggttgtaactttgcaagctgagttagcatatgttcaagcccgcctttctaccctaccacacctacctatgcgacaaagtccaattacaccaacagggctgcaatcatcttcagatatcttctgcactacttcaagcatatcatcttcaagtaataatatggaatatcctcaatttgacataactgcgggtttaagtgattcgttcgatgaaaaagaactggagaactttgagctccatacattagcacgagagttggtttctagacacttacctggagttagatttagaccttcaccataa

SEQ ID NO: 26 - protein, 214 aa, Artificial Sequence
  Description of Artificial Sequence: Synthetic polypeptide
MNGGSCGGADREYNNNNNNNVVGGGGGGPCGACKFLRRKCVRGCIFAPYFDSDQGTAHFAAVHKVFGASNASKLLLRIPAHKRLDAVVTLCYEALARVRDPIYGCVAHIFTLQQQVVTLQAELAYVQARLSTLPHLPMRQSPITPTGLQSSSDIFCTTSSISSSSNNMEYPQFDITAGLSDSFDEKELENFELHTLARELVSRHLPGVRFRPSP

SEQ ID NO: 27 - DNA, 2205 bp, Artificial Sequence
  Description of Artificial Sequence: Synthetic polynucleotide
atgtcggataaaaaatctgtctcgacgccatttgaatgttgcagaatcttgtttaagtttctgctgtttatggttattatcagtaatgtggcgatccatgtaacagctttgagtgggcgagaaggaataaccccaagtacggaatggggtttggggcctctggtgaagagaggagaaagaaaactagtagtttcaactgaaaatggggaggtctcttcagtcagagtagctgatggaatcaccggttcctatcatcttcagttcatcacattggagcccaattccctcttccttcctgttgttctacatgcagatatggtcttctatgtccacactgggtcgggaaggctgacttggatggatgaaactgaacaaaagtcagtggatttaagaattggagatgttttcaggttgccctttggaactattttcttcatagagagcaacttagagcctgcgcgacagaaacttagagtttattccatctttaccaattcaggggatgatttgagagagccgttgtccggaccacactctagcatccgtgatatggttcttggattcgataggaaagttctccaggcggcatttcatgtaccagaggatgtgatagatgaagtgttgaatgggacagaagtaccagccatcatacatggtgtgcccaagacaacaaaaaagaccctgtgggaaatggaggctcaattcatgaaaagtcttctaggaaggggtggtcacggtttctttgactcccaaagcaataaaaagaagactgaattgttcaatattttcaaagagaaaccagattttgagaattgcaatggctggagcactgtaattacacggaaaaaattacccgcattaaagggttcccacattggtatttatgtagtgaacttaaccaagggatcaatgatggcgccacactggaatccaacggcaactgaaataggaatagcattgcaaggagaaggaatggtaagggtagtttgctcaagcacgggaacaaagcaaggatgccaaaacatgaggtttaaggtggaagaaggagatgtatttgcagtgccaaggtttcgtcctatggctcaaatggctttcaacaacaactcatttgtctttgttggttttagtacaactacaaagagacatcatcctcagtacctaacagggaaggcttcagtcctccgaacactggataggcaaatcttggcagcttcctttaatgtgactaacacaacaatggatcggattctggaggcacagggtgagtcagtcatactggagtgtacttcttgtgctgaagaagaagtgagattaatggaggaagaaaggaggagggcagaggaggaagaaaggagaagggaagaagaggaggcaaggcagagggaggaagaaaggaggagggaagaagaggaagctagaaggaaggaagaggaagaagcaaggaaggctgaagaagaaagaagaaagagagaggcagaagaagcaagaagacgagaagaggaggcaacaagggagaaagaggaacaaaggaggagacaagaagaagaagccaggagaagggaagaggaggaagccagaaggcaagaagaagaaatcagaaggagacaagaagaaggggaagctaggaagagagaagaggaagaagcagctagaaggcaacaggaggaagaagctgagagagaggcagaagaagcgaggacaagagaagaggaagaggcagctagaaggcagcagggggaagaagcacaaagggaggcagaggaagcaagaaggagagaggaagaagcagcaaggaggagggaggaacaagcgcagagagaggcggaggaagcaagtaggagagaggaggaagcagcagctagaaggagacaggaacgagaggaagcagaaagggaaagacaagcagaggaagccaggagggagggagaggaaacaaggagacatgaagaagaagaagaagaagaagaggaggaggaggaaacaaggagaggagagaggggagaggaggaggaggaaggaggaagaaaagaagaggaggcggcaagagaggccgagaaaagaaggcaagaagaagcccagagacaacaagaagcagctaggagacaggaagaagaaatggaaagaaggcatcaagaagaagaaaccgaggaagaggagcagggtccttacgcacggaggaaaagaacattccttaaaacagcatga

SEQ ID NO: 28 - protein, 734 aa, Artificial Sequence
  Description of Artificial Sequence: Synthetic polypeptide
MSDKKSVSTPFECCRILFKFLLFMVIISNVAIHVTALSGREGITPSTEWGLGPLVKRGERKLVVSTENGEVSSVRVADGITGSYHLQFITLEPNSLFLPVVLHADMVFYVHTGSGRLTWMDETEQKSVDLRIGDVFRLPFGTIFFIESNLEPARQKLRVYSIFTNSGDDLREPLSGPHSSIRDMVLGFDRKVLQAAFHVPEDVIDEVLNGTEVPAIIHGVPKTTKKTLWEMEAQFMKSLLGRGGHGFFDSQSNKKKTELFNIFKEKPDFENCNGWSTVITRKKLPALKGSHIGIYVVNLTKGSMMAPHWNPTATEIGIALQGEGMVRVVCSSTGTKQGCQNMRFKVEEGDVFAVPRFRPMAQMAFNNNSFVFVGFSTTTKRHHPQYLTGKASVLRTLDRQILAASFNVTNTTMDRILEAQGESVILECTSCAEEEVRLMEEERRRAEEEERRREEEEARQREEERRREEEEARRKEEEEARKAEEERRKREAEEARRREEEATREKEEQRRRQEEEARRREEEEARRQEEEIRRRQEEGEARKREEEEAARRQQEEEAEREAEEARTREEEEAARRQQGEEAQREAEEARRREEEAARRREEQAQREAEEASRREEEAAARRRQEREEAERERQAEEARREGEETRRHEEEEEEEEEEEETRRGERGEEEEEGGRKEEEAAREAEKRRQEEAQRQQEAARRQEEEMERRHQEEETEEEEQGPYARRKRTFLKTA

SEQ ID NO: 29 - DNA, 1302 bp, Artificial Sequence
  Description of Artificial Sequence: Synthetic polynucleotide
atgggcgtaccagaatcggaggtggtgtcacaaggtgaggttgaatcaccattgcaaccagatcaaaaccagcacaagaaccatcagttcccgtccctcggtagacaagcatcgatctactccctcactctcgacgaattccaacacaccctatgtgaaagtggcaagaatttcgggtcgatgaatatggatgaattccttaacagcatttggactgctgaagaaaaccaagcccacgcacacgcccatgcccatgccgcgcacgggcatgcgcacgcgcattctcatgctcatagccaagcaccaagtacaggggaagccactagcacaccacattttgcgataggacagagcaatgtttcaatggagaaagctattgccaagcagccaagcttgccaagacagggttctcttacgcttccggaacctttgtgtcggaaaactgtggatgaagtttggtcagaaattcataagagccaaaaagagcaacatcagaataatgggggcagtgtcccggacacgggtaattccgctcaacggcaggttacatttggcgaaatgacacttgaggatttcttggtcaaagcaggggtagtacgcgaacaggagaatgcccctgcacctcctcaacagcaatcatatatgatgtatcaaaacagcaacaatcccgctatggccaatatggctcgacctgttattggcttaggtggagtcacgggcagcgttggagttggcattcctagctatccaccacttcctcagaccggggtggttgaggccccaatatacccggtaagtatgaaaaggggtgccggattcccacaacagccaacggctgtttacggcgggagaatggggaatggtggcggggtcgggtatgggcaagtacaaggagtggccgggatggggtcgccactaagtccagtgtcgtcggatggattatgcgttaatcaagtcgatagcgggggtcaatacgggttggaaatgggaatgagaggaggaagaaaacgcataatagatggtccggtagagaaagtggtggaaaggaggcaaaggagaatgatcaagaatagagaatcagcagcaagatcaagagcaagaaagcaggcttacacagtagaacttgaggcagaactgaaccagctaaaagaagagaatgcacatctgaaacaggccctggcggagctcgagaggaaaaggaaacaacagtactttgacgaagggaaaatgaaagtgcaaacgaaagcgcaaaaggcgactaacaaattgagaggtatgaggaggagtttgagttgcccttga

SEQ ID NO: 30 - protein, 433 aa, Artificial Sequence
  Description of Artificial Sequence: Synthetic polypeptide
MGVPESEVVSQGEVESPLQPDQNQHKNHQFPSLGRQASIYSLTLDEFQHTLCESGKNFGSMNMDEFLNSIWTAEENQAHAHAHAHAAHGHAHAHSHAHSQAPSTGEATSTPHFAIGQSNVSMEKAIAKQPSLPRQGSLTLPEPLCRKTVDEVWSEIHKSQKEQHQNNGGSVPDTGNSAQRQVTFGEMTLEDFLVKAGVVREQENAPAPPQQQSYMMYQNSNNPAMANMARPVIGLGGVTGSVGVGIPSYPPLPQTGVVEAPIYPVSMKRGAGFPQQPTAVYGGRMGNGGGVGYGQVQGVAGMGSPLSPVSSDGLCVNQVDSGGQYGLEMGMRGGRKRIIDGPVEKVVERRQRRMIKNRESAARSRARKQAYTVELEAELNQLKEENAHLKQALAELERKRKQQYFDEGKMKVQTKAQKATNKLRGMRRSLSCP

SEQ ID NO: 31 - DNA, 1266 bp, Artificial Sequence
  Description of Artificial Sequence: Synthetic polynucleotide
atggaggaaaaagatgaacttgaggaagaagaagaatatgttgatgatgaaatcaagaacaatttaccagtccaaaactcatcttcaataagttggttcacaaaaatgatatctttacaagtagagatcttcaccactatcttagtttcccccattttctatatcctctcttttgtatctgacttcaacttcctccgccctgaagaaaccgaaaagaacgtagctgtagctgtaaatgctgctgctacagtaccttcaaaagtagtacatggaagtactttactgctcaagaaatttggtgttggaattcttggagctgcttatgttggaatggttttgacaacgttgttgattttgtcgggggttctgggatttgggttagtgagaatgtgggcggaagagcctgtggtattgagagagaagctgtattttgattatgcagatgtttatcctaaggctgttttttcttttgctgaatatggtctggagaattataaccataattttatgatgttgaagcagaagaagaattttggtgtgccagttgggcatacaatgtatgtttctttgtttctactgatgcctgaatctgatttcaacagagatattggtgttttccagttggttgcagaagcgttatcagccgaggggatcataatggcaagatcaagtcatccacgtatgttgcgattcagaagcctgccaatccgtctcatgcgagaatttattatgagtgtgcccctagtacttggacttacagctgaaacacaaaggatgatcattccaatgttaaagcataaggaaggtattccaagaacagaggcaatcaaaataactatgatacctcgagctggaacgctagccctgccgcagctttatcaatcggagatcatattgaagtctcatcctccttggtataaagacttggcatacaagtggaaatggacattctccgtctggacctctatgtatatgtatgttacactgctcataattctactcaactggtgcagaccgctcgtatttccagtgatcgcaacaagctttaggacacgcgttgatgagagtttaacagtggaagcatcagaagaaccacaagagaaagctcgagaagaaagtgatgtgtcggagtcggtaagaagatggcggcagagcagaagaaagaggaaggcaatgcttcaacagagtgtctcgccagagttcgcggatgattctgcatcaagcatttctgtgactagggaggatacagctgagtcaagcgagtaa

SEQ ID NO: 32 - protein, 421 aa, Artificial Sequence
  Description of Artificial Sequence: Synthetic polypeptide
MEEKDELEEEEEYVDDEIKNNLPVQNSSSISWFTKMISLQVEIFTTILVSPIFYILSFVSDFNFLRPEETEKNVAVAVNAAATVPSKVVHGSTLLLKKFGVGILGAAYVGMVLTTLLILSGVLGFGLVRMWAEEPVVLREKLYFDYADVYPKAVFSFAEYGLENYNHNFMMLKQKKNFGVPVGHTMYVSLFLLMPESDFNRDIGVFQLVAEALSAEGIIMARSSHPRMLRFRSLPIRLMREFIMSVPLVLGLTAETQRMIIPMLKHKEGIPRTEAIKITMIPRAGTLALPQLYQSEIILKSHPPWYKDLAYKWKWTFSVWTSMYMYVTLLIILLNWCRPLVFPVIATSFRTRVDESLTVEASEEPQEKAREESDVSESVRRWRQSRRKRKAMLQQSVSPEFADDSASSISVTREDTAESSE

SEQ ID NO: 33 - DNA, 597 bp, Artificial Sequence
  Description of Artificial Sequence: Synthetic polynucleotide
atgtataactcaagcaactacagctgtaattacaaccccattttctcatctaatttattcaacatcccttctccttgtatgcaatatgaacacgaacttttcttccaatattaccatgatcaacttcaacagaatcttgacgataccttagctgagatcagtactgagactgccattattaacacggcagattccagcaaagacgaggctataatcagtagaaatgaacttgaacaagatcaggaagcgcgtaagaataaaaagggtaaagtaagcagcaacaagagagtgtctaagaaagatagacacagcaagattaacactgctaaaggcccgagagaccgaagaataagactttcaattgatattgctcgcaattttttcaatttacaagacatgttgaggttcgagaaggccagcaaaactctggagtggttgcttataaagtcaaaatctgatatcaaggagctctccaaaagtcgaataagcaaattaagatgtagtactgttatgggtgcaaatagtgaaacctccacttctgaatgtgaagttgtatcaggaattgatgaatctccatccaatcaaggcaaatgctaa

SEQ ID NO: 34 - protein, 198 aa, Artificial Sequence
  Description of Artificial Sequence: Synthetic polypeptide
MYNSSNYSCNYNPIFSSNLFNIPSPCMQYEHELFFQYYHDQLQQNLDDTLAEISTETAIINTADSSKDEAIISRNELEQDQEARKNKKGKVSSNKRVSKKDRHSKINTAKGPRDRRIRLSIDIARNFFNLQDMLRFEKASKTLEWLLIKSKSDIKELSKSRISKLRCSTVMGANSETSTSECEVVSGIDESPSNQGKC

SEQ ID NO: 35 - DNA, 1038 bp, Artificial Sequence
  Description of Artificial Sequence: Synthetic polynucleotide
atgtatccgtcaagcaacatctgtaattacaaccccaatatttcctcctcaaataacttatttcacattccatctcctaattctatgcaatatgaacacgaacttttccaatatttccacgaccatcatctccttcaaccccaacaacaacaactactcttgactacacctgatcattacatggcagcagattccaacaaagataccgtaatcagtagtactattaatcaactggaaggtcctaaagaagttgaattacaaggcagctgcaagaacaaaaatggtgaaaataagagagctgttgcttacaagaaagatagacacagcaagattaatacagctcacggccctagagatcgaagaatgagactttctctcgatgttgctcgcaaatttttcaatttgcaagacttgcttggattcgataaggccagcaaaactgtggagtggttgcttaccaagtccaaatctgctatcaatgagctcgtccaaagtactgctactggtgcaattagtacatcctctacgacatccgagtgtgaagtgatatcaggaattgatgaatctacaaccactaatgatattcagaagcagccaaatagaagtaaagtaggggagaagaaaaaggctaataaactagctcgtagagctgcatttaatcctgtggcaaaggaatcaaggaaacaagctagagcgagggcaagggagagaacaaaaataaagaaaagccttttaaatattggtgatcagtctatggcggctgatgatttaaaacgattaggatgttggagtccttttgaaacaggtgaagaatcaggtattcaaggctatagtactaatcatcaagtagaagaccaacacactacgaaccacgaggagcatcttttggggactaaagagaatgttgatggctgtaatttggttgttactggcaactggaacccatttactatcttcaactatcaccacaatactgaaatttctcacgagcaacaatttacaaacttccagttttctgggaagttttgggaagtttag

SEQ ID NO: 36 - protein, 345 aa, Artificial Sequence
  Description of Artificial Sequence: Synthetic polypeptide
MYPSSNICNYNPNISSSNNLFHIPSPNSMQYEHELFQYFHDHHLLQPQQQQLLLTTPDHYMAADSNKDTVISSTINQLEGPKEVELQGSCKNKNGENKRAVAYKKDRHSKINTAHGPRDRRMRLSLDVARKFFNLQDLLGFDKASKTVEWLLTKSKSAINELVQSTATGAISTSSTTSECEVISGIDESTTTNDIQKQPNRSKVGEKKKANKLARRAAFNPVAKESRKQARARARERTKIKKSLLNIGDQSMAADDLKRLGCWSPFETGEESGIQGYSTNHQVEDQHTTNHEEHLLGTKENVDGCNLVVTGNWNPFTIFNYHHNTEISHEQQFTNFQFSGKFWEV

SEQ ID NO: 37 - DNA, 1014 bp, Artificial Sequence
  Description of Artificial Sequence: Synthetic polynucleotide
atgtatccgccaagcaatagctgcaactacagccccattttcaacatcccttctccttgtatgcaatatggagacgaactattcttccaatattatcatgacgattaccttcaagagcaacaagtaccgttgatagaagatcagagtcttgacatcttagctgagagcactgagactgttactaataacaaagaaaccgtcatcaattctgatcatagtgtaaaagtttataacatagaaactgttacaaacagtcagggtttgggaggaaatgaagaaaaaagagtagaaggccgcgaaaacaaaagagatgatatgagcggcaccattagtatcattcatggacggaaaaacaagaaatgttcccataaagatcgacatagcaagattagcactgctcgtggccttagagatcgaaggatgagactttcccttgatgcagctcgcaagtttttcagtttacaagacatgttggggttcgataaggcaagtaaaactgtagaatggttgcttaccaaatcggagtctgaaatcgaagagctagctaaaggcaataaagaaggagaatcccttcctaaacaaagctgcagtactaccaatggaattggtgcaattagtactgcaatatcctctatttctgagtgtgaggttatatcaggaactgatgaatcttcttctattactgataaaaagaagctggaaactgctaaaggaccgttgaaaaagaagggtaaaactgctcgtagagctacatttgatcctcttattacaagggaatcgaggaatcaagcaagggttagggctagagagcgaacaaaactaaagaaaagccttagtaaatccaaagccatgactcatgagaacagtgctgatgactgtaatttggtggttaattttggagattggagtcaatttagcatcttcaactatcagcaaaatgcagttggaatttcccatgatcagcagcaatttacagacttccaattttgtggtaataagctgtgggaagtctag

SEQ ID NO: 38 - protein, 337 aa, Artificial Sequence
  Description of Artificial Sequence: Synthetic polypeptide
MYPPSNSCNYSPIFNIPSPCMQYGDELFFQYYHDDYLQEQQVPLIEDQSLDILAESTETVTNNKETVINSDHSVKVYNIETVTNSQGLGGNEEKRVEGRENKRDDMSGTISIIHGRKNKKCSHKDRHSKISTARGLRDRRMRLSLDAARKFFSLQDMLGFDKASKTVEWLLTKSESEIEELAKGNKEGESLPKQSCSTTNGIGAISTAISSISECEVISGTDESSSITDKKKLETAKGPLKKKGKTARRATFDPLITRESRNQARVRARERTKLKKSLSKSKAMTHENSADDCNLVVNFGDWSQFSIFNYQQNAVGISHDQQQFTDFQFCGNKLWEV

SEQ ID NO: 39 - DNA, 867 bp, Artificial Sequence
  Description of Artificial Sequence: Synthetic polynucleotide
atgggcctctcacaatatccagctccagcagatgcaggagtactgtgtgtgattcttgtaaacacagccatatctatttccattgtcaaggagatagtccgatcgatccttcacgttattggcatccatatcgcatcatgggaagattattcttttgaaggatcatttgaatgccgcggaagcccatcagagtcatacatggaggagtttagaagccgaacacctgcatttcgttatgactcggtgtgtatctctaaccaccctgagcaagaatgctctgtgtgcctgactaaattcgagcctgacacagagataaaccgtctctcctgtggccatgttttccataagctgtgtctagagaagtggctcaagtattggcatgtaacttgccctctttgcaggaaacacatgatgcctcacgagcaagaggacgatacatgtccaatgtcattttccagctatgttgcgcgaactctccaaaatgctaccgcatttatgttggatcctccaaaaatgcactacttttggaggatccgacatgtgcctgatgacattttcggagaatctgagcaacattgctttccagtagccaactcagagagtttcgagccaactgacatgctagtgcgagtcaacgcagggttcctgtggtatctgcacctgaaagaacctgcatgtgtagttggtgagcacaagcagctgtaccttacacttgatgtctttcgcaatgctgacggtgaagaaggcgtcgaggatggtaatggtgccatagttggttgtggttgttcagccatccttcagcagattctgcagaagaaattaatagatatgaacaagaaattctggattgactatgaggtagagtag

SEQ ID NO: 40 - protein, 288 aa, Artificial Sequence
  Description of Artificial Sequence: Synthetic polypeptide
MGLSQYPAPADAGVLCVILVNTAISISIVKEIVRSILHVIGIHIASWEDYSFEGSFECRGSPSESYMEEFRSRTPAFRYDSVCISNHPEQECSVCLTKFEPDTEINRLSCGHVFHKLCLEKWLKYWHVTCPLCRKHMMPHEQEDDTCPMSFSSYVARTLQNATAFMLDPPKMHYFWRIRHVPDDIFGESEQHCFPVANSESFEPTDMLVRVNAGFLWYLHLKEPACVVGEHKQLYLTLDVFRNADGEEGVEDGNGAIVGCGCSAILQQILQKKLIDMNKKFWIDYEVE

SEQ ID NO: 41 - DNA, 2562 bp, Artificial Sequence
  Description of Artificial Sequence: Synthetic polynucleotide
atgaatcttcaggtggatgatcaaatgatactcatttctcagtactatcctggtatctacactcaagagttaccagaacaaggggaggcgaaacaaaggaggagacgaaagaagaacaaaggagaagcaagtgaggttatgaggaaaagaaagcttagtgaagaacaagtgaatctgcttgaacagagctttgggaaagagcacaaactggagtccgagaggaaagacaagcttgcctctgagctggggcttgatcctaggcaagttgctgtctggtttcagaacagaagggctagatggaagaacaagaagttggaggaggaatactctaagttgaagtctgagcatgacactaacattgttcataattgccgtcttgaaaatgaggttttgaagctgaaggaacagttgtctgaagcagagaaagagatacaaaggttgctgatggagagatgtgatggggttaattcgagcaatagcccaactacttcatcactctcaatggaagcagccaatatggaacctccttttcttggggaatttggaatggaaggatttgacaatacattttatgtgccagaaaacacttactctcagggattggaatggaatggaccattttttgcacctcctgatattgattatgggatcattaggttccagacattacccgaccccactattcctgggcagtatgcgaactacacatggggtagtgaatcttatacacaattgcttcagtccgttaggcacaagctcaacccttctgttcatttttatgtcattcgaggcattgcactagctatgcaaatatggttgtatgagtgttgctctaccgtcaacactgatatagctacaaggatttctaattcaatctctcgcatacttagctggtcagctagtaaggacaagatatggttatctgcaattgaagatagaatgatcaaaccatcatggatcaagttcaccaacataattgaagcaccagaggagctttcaagaatgaatttgccaaataaagttgaatacattcttgaagaagttgaaacaaagtccgagcatccgatagatgctccatctccatccgttggttcagatcttggaactttcaagaaagaggtttttgaagaactagatacagggcaggtgaatgatataaaaattatggagaatgttcctgtaggtgttgatttatcttcccaatttgaaggggcatttgatgaagagaatgcagagaaggaaactatgcatgtagaatctccaaaacagaaagctacaataagcattccaggaaaacaaaaaaatgaggagaaggagacaaaaatacaatctcacattcaagaagagaacgttatacaacaaggagatgattgttgtgaagatttcagtggtgaatcagccgactacattaatataggtgattcagacaatgactctagatctgaaaaaagagaagtaacacttgatgattttgagctgccagagaacttctcccagattattaattctggggggagaacttctgttggacctccaattttcctcatcaagcatccatttactggggttattggcgaagatgttgatcctgacttattggaagaattcaataagtggttatactttggtatcgatacagtttcaaagaggaggaaggcgccttattctgtaaaagataaccagcttaagccgtggtatgattttggagtggagaaagttgataaaaatgagaggttttatactttggtacaccccgggcaagtcctcaacgatacgcacattgatgttattttatactatttgagaaagagaggaaagtatggtcgtcaaaacaaaatatggtttacaatcattgattgtatgttcaacactagaattgaacaaatttatcagaggtacatcaatactcctgccgataagaagcttgttgttgtcaaatcccaagacgtcgtatcagaatacatattggggtacagattactcgcaaatattgcattggatcaagttgattttgtgattatgcccataaacattgtgaaaaaattttattggttgttggttgtgtttgacattaccgatagggttctatatgtttatgattctatgttctcttcacgaaatcacaaccttgttgaatttgttgtcaacaagtttgctgttatgatccccctctacttgtcatgcaccgacttctatggcaagcgtccagacatcaactacaagaacacaaaagcatacattgaaaaatgtgttactgaccctcttgacattcagtggttggtcggtgagatactccatcaaaatgagggatcacttgactgtagtgtatacgtggctgcatttacagaatatgtcagcattggagagctagcagtttcaaaggaagacctttctgatattgatcaacatcgtagacgctatggagcgctactttgggattatgataggaagaagcaagatactggtgcaattagtgagagcgaggtgactggcagattagcaagaagaaaaggtgcaccagctgtgaacgagagaacacaagtccggaagaagaagaattag

SEQ ID NO: 42 - protein, 853 aa, Artificial Sequence
  Description of Artificial Sequence: Synthetic polypeptide
MNLQVDDQMILISQYYPGIYTQELPEQGEAKQRRRRKKNKGEASEVMRKRKLSEEQVNLLEQSFGKEHKLESERKDKLASELGLDPRQVAVWFQNRRARWKNKKLEEEYSKLKSEHDTNIVHNCRLENEVLKLKEQLSEAEKEIQRLLMERCDGVNSSNSPTTSSLSMEAANMEPPFLGEFGMEGFDNTFYVPENTYSQGLEWNGPFFAPPDIDYGIIRFQTLPDPTIPGQYANYTWGSESYTQLLQSVRHKLNPSVHFYVIRGIALAMQIWLYECCSTVNTDIATRISNSISRILSWSASKDKIWLSAIEDRMIKPSWIKFTNIIEAPEELSRMNLPNKVEYILEEVETKSEHPIDAPSPSVGSDLGTFKKEVFEELDTGQVNDIKIMENVPVGVDLSSQFEGAFDEENAEKETMHVESPKQKATISIPGKQKNEEKETKIQSHIQEENVIQQGDDCCEDFSGESADYINIGDSDNDSRSEKREVTLDDFELPENFSQIINSGGRTSVGPPIFLIKHPFTGVIGEDVDPDLLEEFNKWLYFGIDTVSKRRKAPYSVKDNQLKPWYDFGVEKVDKNERFYTLVHPGQVLNDTHIDVILYYLRKRGKYGRQNKIWFTIIDCMFNTRIEQIYQRYINTPADKKLVVVKSQDVVSEYILGYRLLANIALDQVDFVIMPINIVKKFYWLLVVFDITDRVLYVYDSMFSSRNHNLVEFVVNKFAVMIPLYLSCTDFYGKRPDINYKNTKAYIEKCVTDPLDIQWLVGEILHQNEGSLDCSVYVAAFTEYVSIGELAVSKEDLSDIDQHRRRYGALLWDYDRKKQDTGAISESEVTGRLARRKGAPAVNERTQVRKKKN

SEQ ID NO: 43 - DNA, 2790 bp, Artificial Sequence
  Description of Artificial Sequence: Synthetic polynucleotide
atgatagtagtaagatggtggatgacaacattccaattgacagagctgtttgtgagttgtttagttcatttgacttacgggctttacatattcagcacagcagtggccggtgatgtttcccagactctgagcgattggcttttcaagccaaatttggaaactagccttaaaacagatgattcaaaaaagactaacactgatttgcctcctattgtgttggttcatggaatctttggttttggcaaagggagattgggaggactttcatatttcgctggtgcagagaaaaaggatgaaagggttctagtaccggatttgggttcacttactagcatttatgacagggcacgtgaattgttttattatttgaaaggagggcaggttgattatggggaggaacacagtaaggcttgtgggcattcccaatttggacgaatttatgaacaaggacactaccccgagtgggatgaagatcatcctattcattttgtgggccattcagctggagcacaggttgttcgagtcttgcaacagatgctggctgacaaggcattcaaaggttacgacaacacttcagagaactgggtgttaagcctaacatcattatctggagcacttaacgggacaacccgaacttactttgatggaatgcaacctgaagatgggaagtccttaacgcccgtatgtttgctccaactttgccgcattggagtaataatttatgagtggcttgacattcccttgctgaaggactattacaactttggctttgaccacttcagtatgtcctggaggaaaagtggtatccggggttttgttgattgccttttagggaatggcggtccatttgcttcgggagattggatacttccagatcttactatccaggggtcaatgaagttgaacagccacttacgtacatttccgcaaacatactacttcagctatgctaccaagcgtaccacacaagtaatgggtcttacagttccttctggcgttctagggatacatccgctgctattcatcagagtcctgcaaatgagccaatggcggcatccacaagatgtttctcctccgtacaagggctatagggatgaagattggtgggacaatgacggtgctctcaacaccatatctatgacgcacccacgcttgccggttgaacacccgagtcaccttgtcgttaaagattctgattgtcagcccttgcaacctggcatctggaatcatcaagtttcctcttctgtgcagttgttatcaccaccattggctcgtaggctttccgtggggaaatgtgaaagggaaatatctgtcattctcagttatgttacggaaagatcagctctcaccattagaaaccccgatggaagccaacaacaaaccaccaagatcctctttcaccaccagaagtgcgcatgccttccgtcttactgtgaacgcccacgtccaatggaatttctgggaaggatttcaagaaatgtagaaggaaatgatactaaggctaggatttctgcagctattttactagtttgcattatccttcctttgctagcctcagcatttcttgatcatcttcctgaatttctagaacatgattctagaaataaagatgtaacaatccgtggtgataataatattgttcgtgccaatgacaatgactttactcttcctcgctcacatgagaaaaagaatgaaagatctttaagagaaaagaagtcaaagaagaagaagcataagaagaagaagaacaagaagggaaagaaatcacacaaagataaaatttttgattttgaccatatttttggaggaaaccaacaagaaggagatgaattttccccttatttgcaaccatttgatgtgcctcaaacaacagaagaacaagaacagaccgagaattatgatggattacgtgagggattttaccagaaaacatgtcctcaagcagagaatattataagaaatggtctaatcagggcctttcagaatgactctaccattgctgctgcattacctcgccttctcttgcatgattgctttgtcaatggatgtgatgggtcgatattactagatacaacacccagtggtgcaagagtggagaagttagcaggcacaaatggtgctacagtcaagggatttgaactcatagacgagatcaaagccgagctcgagagacaatgccctggcattgtctcctgctctgatattttggcatacttgtcgcgcgatgcctttgttttatcaggcctccccaattacaacgtgctaggtggtcgacgcgatggcatggaatccaatgaagcaaacgttgttggaaacctaccacttcctggcgacacagtggatcaaatgattgatctttttcaaaagaaaggcctaaattcggaagatttggttgtcctaattggtgcacattcaattggagtagcccattgtttcaacttcctttacagattggacgaaccagagaaggcacaaatgttagatccaaggcttgctggagtcatgagatttatttgtactaaccaaatgaataccttaccttttgatcccacaacacagtacaagatggattcaattttctacaagcaactaatgatgaagaaagggttgattgaatcggatcaaatactggctcaagatattagaacgaggggcttggtgcaaaagtttggtgatgatgaaatgggatggtttgataagtttggtaaggctatgaataaattgggagcaattgaagtgctcactggaaaccaaggccagatcaggagacagtgtagagctgttaactga

SEQ ID NO: 44 - protein, 929 aa, Artificial Sequence
  Description of Artificial Sequence: Synthetic polypeptide
MIVVRWWMTTFQLTELFVSCLVHLTYGLYIFSTAVAGDVSQTLSDWLFKPNLETSLKTDDSKKTNTDLPPIVLVHGIFGFGKGRLGGLSYFAGAEKKDERVLVPDLGSLTSIYDRARELFYYLKGGQVDYGEEHSKACGHSQFGRIYEQGHYPEWDEDHPIHFVGHSAGAQVVRVLQQMLADKAFKGYDNTSENWVLSLTSLSGALNGTTRTYFDGMQPEDGKSLTPVCLLQLCRIGVIIYEWLDIPLLKDYYNFGFDHFSMSWRKSGIRGFVDCLLGNGGPFASGDWILPDLTIQGSMKLNSHLRTFPQTYYFSYATKRTTQVMGLTVPSGVLGIHPLLFIRVLQMSQWRHPQDVSPPYKGYRDEDWWDNDGALNTISMTHPRLPVEHPSHLVVKDSDCQPLQPGIWNHQVSSSVQLLSPPLARRLSVGKCEREISVILSYVTERSALTIRNPDGSQQQTTKILFHHQKCACLPSYCERPRPMEFLGRISRNVEGNDTKARISAAILLVCIILPLLASAFLDHLPEFLEHDSRNKDVTIRGDNNIVRANDNDFTLPRSHEKKNERSLREKKSKKKKHKKKKNKKGKKSHKDKIFDFDHIFGGNQQEGDEFSPYLQPFDVPQTTEEQEQTENYDGLREGFYQKTCPQAENIIRNGLIRAFQNDSTIAAALPRLLLHDCFVNGCDGSILLDTTPSGARVEKLAGTNGATVKGFELIDEIKAELERQCPGIVSCSDILAYLSRDAFVLSGLPNYNVLGGRRDGMESNEANVVGNLPLPGDTVDQMIDLFQKKGLNSEDLVVLIGAHSIGVAHCFNFLYRLDEPEKAQMLDPRLAGVMRFICTNQMNTLPFDPTTQYKMDSIFYKQLMMKKGLIESDQILAQDIRTRGLVQKFGDDEMGWFDKFGKAMNKLGAIEVLTGNQGQIRRQCRAVN

SEQ ID NO: 45 - DNA, 2478 bp, Artificial Sequence
  Description of Artificial Sequence: Synthetic polynucleotide
gtatgtttcagtctcacagagatcgttcatcgataccacagccatgtggaagcagaaaaagagagctctgcagaagttttggacaccgagcactctaaatatgcaagcttcatgacagtgggacaactgttacaaacggtaggaaggcaactcgaggaacctgctgttgatgatctcagtgtaactgaccttgtccatttggaaaaccaactgccaactgctctaatgcaagtcagatctagcaagacgcatttgatgattgaatctatcaaaagtcttcgtgagaaggaaaaactgctgagtgaagaaaacaaacatctggagaacaagtacactccagcttacaacttcaaatcagcaatggctctacctatcgacctcgaagccggccttcaagatgaaaccaacaacttggcgcccggggccggaaggctacctgacgacggcaacgaggctcgaatcgaagaacccgaaattcgagccgaagtaccattggatatcaattcacaaatagctctagaagcgaatcagcgttctgaaccggaaagaagcgttcagggcggtgctcgacccatagcccgagacacctacagcacgggggaaatcggggtcagcttgcgtatgattttcgaaatgttacaagcccaacaagcagcgatagctcagttgcagagccgaactcatatgcaaagcgggccgaactccaatccgcttcttcgagaagtcacccccagaacggagcccgccgtagtgaaatcaaacgagcaggaatcggggaccgctcctgaaattgctaaattgctcgaggaactcacaaaacgagtcgaagccaacgacaaaaaagtggaaacgtataacgctagggtcgatcaaatcccgggggctccgccaatgataaaagggctcgattcgaaaaaattcatacaaaagccttttccctcgagcgcggccccaaaaccaatccccaaaaaattccgtatgcccgaaattcccaaatataacggtacgaccgatcctaacgaacatgtcacctcctacacatgtgccatcaaaggcaacgatttggaggacgatgagatcgaatccgtgttgttgaaaaagttcggagagaccctcgcaaagggagcaatgatctggtatcacaacttaccaccaaattccattgattcttttgccatgttagcagattcgttcgtaaaagcacatgctggtgccataaaggttgcaacaaggaaatcagacctcttcaaagtaaaacaaaggggtaacgaaatgctgagggaattcgtatcccgatttcaaatggaacgtatggacttgccaccggtcacagacgattgggccgtacaagctttcacccaaggactgaacgggctaagttcgacagcatcacatcggatgaacaacggttcagcacgtgatacggttcggaacaaccgaaggactgatcgggggcaaaattctcggggacttatgagcaagagcggctttgataaatatgccgatcctatagaagtccctcgattatcggagtataacttcaacattgatacatccgccatcgtatcggccatcggacgcatcaaagacaccagatggcctcgacccatgcagaccgatcctgcccaaaggaatcccaatcaaatgtgcgaatatcatggcacccatggccacagaacggaagattgcaggcaactaagagaggaagtggcccgcttatttaacaaaggacaccttcgggaatttctgagtgatagggcgaagaaccattttaggaacaaggaattcggcaagcaaaacgagccagaagaaccgcaacacgtcattcacatgatcatcggcggcgtcgatgcccctcagggaccgatgcttaaacgcactaaaacatcgattgtgagggaaaagcgatctcgaactcaagattatacacccatagggactttgtccttcagtgatgaagatacagagggaatcatccaaccccataacgatgcactggtaatatccgtactcatgaataaaactaagattaagcgtgtgttaattgatccaggtagctcggccaatatcatcagatcgagggtcgtagaacagctcggcctgcaagatcaggtcgtacccgcaactctggttctaaacggattcaatatggcatgtgaaaccaccaaaggcgagattaccctaccgataaacgtggccggaaccatccaggaaacaaagtttcacgtgatcgaaggtgatatgagatataacgcccttttcggaaggccgtggatccacagcatgagagccgtaccctcgaccctacaccaggtcctcaaattcccaacatcgggaggtgtcaaaatagtgtacggagaacaaccggccgcaaaggaaatgttctccgtcgaagaagcaaaatcaatatcctcgtcttcgccgataaaaggatcaggttcagaaggagacacaatcggagagcagagcgccaaatag

SEQ ID NO: 46 - protein, 825 aa, Artificial Sequence
  Description of Artificial Sequence: Synthetic polypeptide
VCFSLTEIVHRYHSHVEAEKESSAEVLDTEHSKYASFMTVGQLLQTVGRQLEEPAVDDLSVTDLVHLENQLPTALMQVRSSKTHLMIESIKSLREKEKLLSEENKHLENKYTPAYNFKSAMALPIDLEAGLQDETNNLAPGAGRLPDDGNEARIEEPEIRAEVPLDINSQIALEANQRSEPERSVQGGARPIARDTYSTGEIGVSLRMIFEMLQAQQAAIAQLQSRTHMQSGPNSNPLLREVTPRTEPAVVKSNEQESGTAPEIAKLLEELTKRVEANDKKVETYNARVDQIPGAPPMIKGLDSKKFIQKPFPSSAAPKPIPKKFRMPEIPKYNGTTDPNEHVTSYTCAIKGNDLEDDEIESVLLKKFGETLAKGAMIWYHNLPPNSIDSFAMLADSFVKAHAGAIKVATRKSDLFKVKQRGNEMLREFVSRFQMERMDLPPVTDDWAVQAFTQGLNGLSSTASHRMNNGSARDTVRNNRRTDRGQNSRGLMSKSGFDKYADPIEVPRLSEYNFNIDTSAIVSAIGRIKDTRWPRPMQTDPAQRNPNQMCEYHGTHGHRTEDCRQLREEVARLFNKGHLREFLSDRAKNHFRNKEFGKQNEPEEPQHVIHMIIGGVDAPQGPMLKRTKTSIVREKRSRTQDYTPIGTLSFSDEDTEGIIQPHNDALVISVLMNKTKIKRVLIDPGSSANIIRSRVVEQLGLQDQVVPATLVLNGFNMACETTKGEITLPINVAGTIQETKFHVIEGDMRYNALFGRPWIHSMRAVPSTLHQVLKFPTSGGVKIVYGEQPAAKEMFSVEEAKSISSSSPIKGSGSEGDTIGEQSAK

SEQ ID NO: 47 - DNA, 1152 bp, Artificial Sequence
  Description of Artificial Sequence: Synthetic polynucleotide
atgcagtctgtactctggaacctaaggaagattgaaattcaagataaattctgcgatattgaaaggataagtcctgcatacctcaacacaaatgacacggcaaagaaaattcaagaagaaatcaatggcttgcattgtaaactggaggaggctgagggattattaagaatatttgaaccagatacaaaaaaaattacatcactccatgagcttgatttgtgtgaaaaacgtcttcaggttgccttgaaccaagttaggcaaagaatggaacaactctccaacaatcataatacatcaagttatgaagataatatggagcaaataaatgcactccttcaatacatagacaacacacaaactgaggacacaaaaccctcgttggaggaatctccctatgacttatggctagagcttgaagattatagttacacaaactatattaatgacaacaacaatagtcatctctatgctgcctcagaaacatcttctcttactcaaagttctatgagcctttcttctccaattatttatgatgcaatatcccaaacaagtataagtggtgtgactaattatcataaagaagggacttttagttctttaactgatgagaattttaagcaatcacaacattcaaccagaaccttcccaactctcactttacaaacttcattcaaatttgccaagcctgaaatggaaactcccacatctgcactacggccggtagcgccatatctgcatgttgaagcaacagcagcgtgtagccagcaaccagtttcaagtgattattataaagagaacaatgaactcgactgcagatttcaacctaaagttacaacgtctaactatcaaatgtcccaaaaacgtactgcagaaggaagttttagttccttaactgatgaaagctttaagcaatcacaatgttcaaccaggatcttcccacctatcgctccattacaaacttcattctcatttgccacgcctgaaatggaaactccaacctcagcattgcggccggtggcaccatatctgcaggctgaagcagcagcatcctctaaccagcagctaccttctaataatattgaagaagagaaccatgaaatctcttggtttcagcctcaaatgaaaaagtcgaagtatcatcatttagcttga

SEQ ID NO: 48 - protein, 383 aa, Artificial Sequence
  Description of Artificial Sequence: Synthetic polypeptide
MQSVLWNLRKIEIQDKFCDIERISPAYLNTNDTAKKIQEEINGLHCKLEEAEGLLRIFEPDTKKITSLHELDLCEKRLQVALNQVRQRMEQLSNNHNTSSYEDNMEQINALLQYIDNTQTEDTKPSLEESPYDLWLELEDYSYTNYINDNNNSHLYAASETSSLTQSSMSLSSPIIYDAISQTSISGVTNYHKEGTFSSLTDENFKQSQHSTRTFPTLTLQTSFKFAKPEMETPTSALRPVAPYLHVEATAACSQQPVSSDYYKENNELDCRFQPKVTTSNYQMSQKRTAEGSFSSLTDESFKQSQCSTRIFPPIAPLQTSFSFATPEMETPTSALRPVAPYLQAEAAASSNQQLPSNNIEEENHEISWFQPQMKKSKYHHLA

SEQ ID NO: 49 - DNA, 813 bp, Artificial Sequence
  Description of Artificial Sequence: Synthetic polynucleotide
atgggaactggtacttatggagaagtgggacgtacaatacatcaaagatcaggaacacatatacctcaaattctcgatccgcctttgctaggggatagtgattgcaagcgagaaggcaaacatgtagaatttatgcctccaatcatgggtgaaaacttaaaagcagctaatcaatttgaactgatggccccgtcaattgcattcaaatcatatccctattcggaggtaccacaatattctggtggcaatgtggctgctgcatgtggtgaatctttggtacatcaaaatatagaaagatcagtgcataatggtagaatgattttgccaattgaagtgaaggaggagcctatgtatgtaaatgccaaacaataccatggaattctaaggcgaaggcaacttcgtgcaaaggctgtgttggagcaaaaagtggttaaatctagaaagccttatcttcatgaatctcggcaccggcatgcgatgagaagagctagagatggtggaggccgatttctcaacacaaaaaagaagatccaacttcctgctaataataatattaatacaactactccaagtagtaaaggcaaaggttgtgcagcctcggaagtcagttccatggactctgatttctctcaaaattacttgctcaattctggacatattggatcatccaatgctacttctgttgaaggattccagttccaaggaatacataatacagataatcctcaattgggttgtcattatcagtggaatctcaatgacaaccattgctattgcatgcagtcaggagcttctaatctccaaccattttga

SEQ ID NO: 50 - protein, 270 aa, Artificial Sequence
  Description of Artificial Sequence: Synthetic polypeptide
MGTGTYGEVGRTIHQRSGTHIPQILDPPLLGDSDCKREGKHVEFMPPIMGENLKAANQFELMAPSIAFKSYPYSEVPQYSGGNVAAACGESLVHQNIERSVHNGRMILPIEVKEEPMYVNAKQYHGILRRRQLRAKAVLEQKVVKSRKPYLHESRHRHAMRRARDGGGRFLNTKKKIQLPANNNINTTTPSSKGKGCAASEVSSMDSDFSQNYLLNSGHIGSSNATSVEGFQFQGIHNTDNPQLGCHYQWNLNDNHCYCMQSGASNLQPF

SEQ ID NO: 51 - DNA, 762 bp, Artificial Sequence
  Description of Artificial Sequence: Synthetic polynucleotide
atgggagctggtgcttttggagaagccggacgtacaatatatcaaaagtccgatagtgattgcaagcgagatggcaaacgtgtagaatttatgcctccaatcatgggtgaaaacttaagagcagctaatcaatttgaactgatgcccccctcaattgcattcagatcatatccctattcagaagtaccacaatattctggtggcaatgtggctgctgcatttggcgaatctacggtacatcaaaatatagaaagatcagtgcataatggtagaatgattttgccacttgaagtgaaggaggagcctatgtatgtaaatgccaaacaataccatggaattctaaggcgaaggcaactccgtgcaaaggctgtgttggagcaaaaggtggtcaaatctagaaagccttatcttcatgaatctcggcaccggcatgcgatgagaagagctagagatggtggcggccgatttctcaacacaaagaagaagatccaacttactactaataataataataataatgggaatactaatgcaactccaagtagtaaaggcaaaggttcttcagcctcagaagtcagttccatggactcttattctggacatattggatcatccaatagtactgctcatgtccagggatttcagttccaaggaatacataatacagaaaatcctcaactgggttgtcattatcagtggaatctcaatgataaccattgcaattgcatgcagtcaggagcttctaatatccaaccattttga

SEQ ID NO: 52 - protein, 253 aa, Artificial Sequence
  Description of Artificial Sequence: Synthetic polypeptide
MGAGAFGEAGRTIYQKSDSDCKRDGKRVEFMPPIMGENLRAANQFELMPPSIAFRSYPYSEVPQYSGGNVAAAFGESTVHQNIERSVHNGRMILPLEVKEEPMYVNAKQYHGILRRRQLRAKAVLEQKVVKSRKPYLHESRHRHAMRRARDGGGRFLNTKKKIQLTTNNNNNNGNTNATPSSKGKGSSASEVSSMDSYSGHIGSSNSTAHVQGFQFQGIHNTENPQLGCHYQWNLNDNHCNCMQSGASNIQPF

SEQ ID NO: 53 - DNA, 753 bp, Artificial Sequence
  Description of Artificial Sequence: Synthetic polynucleotide
atgcaatatgaacacgaatttttcttccaatattaccatgatcaacttcaacagaatcttgatgataccttagctgagatcagtactgagactgccattattaacacggcagattccaacaaagacgacgctttaataagtagaaatgaacttgaacaagaggaaggatgtgagaataaaaagggtaaaataagcagcaacaagagagtgtctaagaaagatagacacagtgcaaatagtgaatcctctacttctgaatgtgaagttgtatcagaaattgatgaatctccatctaatcataaggcaaatgctaaaggaaattcttgcaacaaggagaaggagaagaagaagaaggagaaggagaaatcagttcgtcgagctgcattttatcatccatttgcaaaagaatcaaggaaacaagcaagagagagggcaagggagagaacaaaactaaagaaaaacttttgtaaatctcatcatttgaacttaagatcttggaatttctccgaagggggcgaagaatcagcgggatatattagcatgaatcttccttgtcaagaaatgcaagctgaaatagttgaagaactcacctcccacaatgagaagcagcttttattagggattaaagaaaacattgctaatgattgtaatttggtggctactggcaattggagcccaaatgccattttcaactatcaacaaaatgctggaattcctcatgagcatcaaattacagacattccgttttcatga

SEQ ID NO: 54 - protein, 250 aa, Artificial Sequence
  Description of Artificial Sequence: Synthetic polypeptide
MQYEHEFFFQYYHDQLQQNLDDTLAEISTETAIINTADSNKDDALISRNELEQEEGCENKKGKISSNKRVSKKDRHSANSESSTSECEVVSEIDESPSNHKANAKGNSCNKEKEKKKKEKEKSVRRAAFYHPFAKESRKQARERARERTKLKKNFCKSHHLNLRSWNFSEGGEESAGYISMNLPCQEMQAEIVEELTSHNEKQLLLGIKENIANDCNLVATGNWSPNAIFNYQQNAGIPHEHQITDIPFS

SEQ ID NO: 55 - DNA, 1422 bp, Artificial Sequence
  Description of Artificial Sequence: Synthetic polynucleotide
atgatgaagcatatagtacatctgggctccacctcaaatcttacagtagcagctagaggccatggtcactcgcttcaaggacaagctctagctcatcaaggtgttgtcatcaaaatggagtcacttcgaagtcctgatatcaggatttataaggggaagcaaccatatgttgatgtctcaggtggtgaaatatggataaacattctacgcgagactctaaaatacggtctttcaccaaagtcctggacagactaccttcatttgaccgttggaggtacactatctaatgctggaatcagcggtcaagcattcaagcatggaccccaaatcaacaacgtctaccagctagagattgttacagggaaaggagaagtcgtaacctgttctgagaagcggaattctgaacttttcttcagtgttcttggcgggcttggacagtttggcataatcacccgggcacggatctctcttgaaccagcaccgcatatggttaaatggatcagggtactctactctgacttttctgcattttcaagggaccaagaatatctgatttcgaaggagaaaacttttgattacgttgaaggatttgtgataatcaatagaacagaccttctcaataattggcgatcgtcattcagtcccaacgattccacacaggcaagcagattcaagtcagatgggaaaactctttattgcctagaagtggtcaaatatttcaacccagaagaagctagctctatggatcaggaaactggcaagttactttcagagttaaattatattccatccactttgttttcatctgaagtgccatatatcgagtttctggatcgcgtgcatatcgcagagagaaaactaagagcaaagggtttatgggaggttccacatccctggctgaatctcctgattcctaagagcagcatataccaatttgctacagaagttttcaacaacattctcacaagcaacaacaacggtcctatccttatttatccagtcaatcaatccaagtggaagaaacatacatctttgataactccaaatgaagatatattctatctcgtagcctttctcccctctgcagtgccaaattcctcagggaaaaacgatctagagtaccttttgaaacaaaaccaaagagttatgaacttctgcgcagcagcaaacctcaacgtgaagcagtatttgccccattatgaaactcaaaaagagtggaaatcacactttggcaaaagatgggaaacatttgcacagaggaaacaagcctacgaccctctagcgattctagcacctggccaaagaatattccaaaagacaacaggaaaattatctcccatccaactcgcaaagtcaaaggcaacaggaagtcctcaaaggtaccattacgcatcaatactgccgaaacctagaactgtataa

SEQ ID NO: 56 - protein, 473 aa, Artificial Sequence
  Description of Artificial Sequence: Synthetic polypeptide
MMKHIVHLGSTSNLTVAARGHGHSLQGQALAHQGVVIKMESLRSPDIRIYKGKQPYVDVSGGEIWINILRETLKYGLSPKSWTDYLHLTVGGTLSNAGISGQAFKHGPQINNVYQLEIVTGKGEVVTCSEKRNSELFFSVLGGLGQFGIITRARISLEPAPHMVKWIRVLYSDFSAFSRDQEYLISKEKTFDYVEGFVIINRTDLLNNWRSSFSPNDSTQASRFKSDGKTLYCLEVVKYFNPEEASSMDQETGKLLSELNYIPSTLFSSEVPYIEFLDRVHIAERKLRAKGLWEVPHPWLNLLIPKSSIYQFATEVFNNILTSNNNGPILIYPVNQSKWKKHTSLITPNEDIFYLVAFLPSAVPNSSGKNDLEYLLKQNQRVMNFCAAANLNVKQYLPHYETQKEWKSHFGKRWETFAQRKQAYDPLAILAPGQRIFQKTTGKLSPIQLAKSKATGSPQRYHYASILPKPRTV

SEQ ID NO: 57 - DNA, 1659 bp, Artificial Sequence
  Description of Artificial Sequence: Synthetic polynucleotide
atgaagtcaccaccaactcatgtcttctttaaacataaaagtatgcttcttaggttgcttatattcatactaggcatttgctcaataaacagaactaacctttgttgtgaccaaccttttgccaccccaatatcttcttcttcttctaccccttcaagtttttcagtgattcaatcatcattgaaacagttaaatattgaagggtattttagtttcaagaatttcgatcacgcggccaaagactttggcaacagatatcacttcttgccatcggcagttctgtatccaaaatcagtttctgatatatcatctaccataaaacatgtttttgacatgggtgttactacagacctaactgttgctgctagaggccatggccattctttagaaggccaagctcaagcttaccaaggagtagtgatcaatatggaatcgcttcgagcgccagcaatgcgtttccacacagggaatcaagaactgccttttgttgatgtctctgcaggagaactttggataaacatcctgcatgaaagtcttaaacttggattaacaccaaaatcttggactgattatcttcacctcaccgttggagggactttgtcgaatgccggaatcagtggtcaagcattcaaacatggaccacagatcaataatgtttaccaacttgaggttgtcactggtaaaggagaggtgattacttgttcagaggagaagaatgctgacctgttctatggtgtattaggaggactaggccagtttggtatcatcacaagggctagaattgctcttgaaccagcacctaaaaaggtaaagtggatcagagtgctgtattcagatttctccacattttcctatgatcaagaacacttgatatcatccgagaactcttttgactatatagaaggatttgtcattatcaatagaacaggattgttaaacaactggaggtctactttcaatcctaaagatccacttctagccaaagagttcagttctgagggaaaagttctgtactgcctagaagttgccaaatacttcaatccagaagagacaaccaaaactgatcagaatgttgatgttcttttatcaaagttgaattatatccaatcgacgctgttccaatcagaagtatcctacgtggatttcctcgacagagttcacgtatccgagatgaaacttcaagagaaggggttatgggatattcctcatccatggctaaaccttctaattccaaagagcaagattcatgactttgcacgagaagtttttgggaagatacttaccgacactagccacggtcctatactcatctacccagtcaacaaatcaaagtggagaaaaggaacatcagtagttacacctgaagaagatgttatgtatctaatagcatttctatcttctgccatgccatcttcaacaggaaaggacggcgtagaatatattctaaataagaataagaagatactaaacttttgcagaaaagcacatattggaatgaaacagtatttgccacactacacaacgcaggaagactggaaaggtcactttggtccccagtgggaaacatttaaaaggaggaaatctacatatgaccctttggctatcctagctcctggccagagaatttttagaagagcatcaggcgttcaacaacaatga

SEQ ID NO: 58 - protein, 552 aa, Artificial Sequence
  Description of Artificial Sequence: Synthetic polypeptide
MKSPPTHVFFKHKSMLLRLLIFILGICSINRTNLCCDQPFATPISSSSSTPSSFSVIQSSLKQLNIEGYFSFKNFDHAAKDFGNRYHFLPSAVLYPKSVSDISSTIKHVFDMGVTTDLTVAARGHGHSLEGQAQAYQGVVINMESLRAPAMRFHTGNQELPFVDVSAGELWINILHESLKLGLTPKSWTDYLHLTVGGTLSNAGISGQAFKHGPQINNVYQLEVVTGKGEVITCSEEKNADLFYGVLGGLGQFGIITRARIALEPAPKKVKWIRVLYSDFSTFSYDQEHLISSENSFDYIEGFVIINRTGLLNNWRSTFNPKDPLLAKEFSSEGKVLYCLEVAKYFNPEETTKTDQNVDVLLSKLNYIQSTLFQSEVSYVDFLDRVHVSEMKLQEKGLWDIPHPWLNLLIPKSKIHDFAREVFGKILTDTSHGPILIYPVNKSKWRKGTSVVTPEEDVMYLIAFLSSAMPSSTGKDGVEYILNKNKKILNFCRKAHIGMKQYLPHYTTQEDWKGHFGPQWETFKRRKSTYDPLAILAPGQRIFRRASGVQQQ

SEQ ID NO: 59 - DNA, 1632 bp, Artificial Sequence
  Description of Artificial Sequence: Synthetic polynucleotide
atgaaattaccatcccattttttatttaagcaaaatgacttgctcctgaaattgcttatattcatactctgcagttgttcaagcaacaaaaataaactctgctgtaattatcatcagtttgccacccctgcagtttctaccccctcaagtttctcactgaattatttatcattgaaacaattacaacttgaaggttaccttaaatttgacaacttagaacatgcagccaaagactttggtaatagatgccacttccttccattagcagttttgtacccaaaatcagtttctgatatctcttccactataaaacatgtctttgaaataggttccaaaactgatttaactgttgctgctagaggccatggccattctctagaaggtcaagctcaagcttatcaaggagtagtgattagtatggaatcactacaaacaccagcaatgaaattcaagactggagaattgccttatgttgatgtttctgctggagagctttggattaatatcctgaaagaaagtcttaaacttgggcttgcacctaaatcttggactgattatcttcacctcacagttggcggcactttgtctaatgctggaatcagtggacaagctttccgccacggaccgcagatcaataacgtccaacaacttgaagttgtcactggtaaaggagaggtgattacttgttcagaggagcagaatgcagacttgtttcatggtgtactaggaggactggggcaatttggtattattaccagagcaaggattgctcttgaaacagcacctaaacaggtcaagtggattagagtgctgtattcagatttttccatattttccaatgatcaagagcacttgatatcaactcaggatacatttgactatattgaaggttttgtcactatcaaccaaactggattattaaataactggaggtctgctttcaatcctaaagatccagttctagccagcaatttcagttctgagggtagagttttgttctgcttagaaattgccaaatacttcaatccagaagtcacagatagtattgatcagaacattgatgtgatcttatcaaagttgaattatatccgatccacgctgttcctatcagaagtctcctacacagaattcctcgacagggtgcatgtctctgagatgaaactccaagaaaatgtttctcatccatggctaaatcttctaataccaaaaagcaggattcttgaatttgcacaacaagtttttggcaagattcttactgacactagcaatggtcctttactcatctaccctgtcaacaaatcaaagtggagaaaaggaacatccatggttacccctgacgaagatgttttttatctgatcgcgttcctatcttctgctatgtcatcttcaacaggaaacgatggactaagacatattcttgctcagagcaaaaggatactgaacttttgtgaagaaacaaatatcggaatgaaacaatatttaccaaattacaagactaaggaagagtggaaggatcactttggtcatcaatgggaagcatttgctagaaggaaatctacatatgaccctttggcaatacttgctcctggccagagaattttcagaagggcagaagcctgtgaacaacaataa

SEQ ID NO: 60 - protein, 543 aa, Artificial Sequence
  Description of Artificial Sequence: Synthetic polypeptide
MKLPSHFLFKQNDLLLKLLIFILCSCSSNKNKLCCNYHQFATPAVSTPSSFSLNYLSLKQLQLEGYLKFDNLEHAAKDFGNRCHFLPLAVLYPKSVSDISSTIKHVFEIGSKTDLTVAARGHGHSLEGQAQAYQGVVISMESLQTPAMKFKTGELPYVDVSAGELWINILKESLKLGLAPKSWTDYLHLTVGGTLSNAGISGQAFRHGPQINNVQQLEVVTGKGEVITCSEEQNADLFHGVLGGLGQFGIITRARIALETAPKQVKWIRVLYSDFSIFSNDQEHLISTQDTFDYIEGFVTINQTGLLNNWRSAFNPKDPVLASNFSSEGRVLFCLEIAKYFNPEVTDSIDQNIDVILSKLNYIRSTLFLSEVSYTEFLDRVHVSEMKLQENVSHPWLNLLIPKSRILEFAQQVFGKILTDTSNGPLLIYPVNKSKWRKGTSMVTPDEDVFYLIAFLSSAMSSSTGNDGLRHILAQSKRILNFCEETNIGMKQYLPNYKTKEEWKDHFGHQWEAFARRKSTYDPLAILAPGQRIFRRAEACEQQ

SEQ ID NO: 61 - DNA, 960 bp, Artificial Sequence
  Description of Artificial Sequence: Synthetic polynucleotide
atgagaaactcttcactaatgtgcaaacaagtatggccaactttgcgaaatttgcctcaaaaggacaaggttgtgtttgtgatgggagtcaccggcgccggaaaatcaagactgtcaatagacttagccactcaattcagaggagaaatagtgaactccgacaaaatacaagtgtacaaaggtcttgatattgccactaacaaaatcacacaagaagaacgttgtggtgtaccacaccatctcctaggcgtaattgatccttacaaagaattcaccaccaaaaacttctgcaacatggcttcacttgcagttaactctataaccgaccgcggtaaacttccgatcatcgttggaggttccaattcgtttatcgaggcgcttgtccacgacaactctcataattttcgtacgaggtatgattgttgtttcctatgggtcgatgtgtccatgaacgtactaaattcatttttgtacgaacgagtggacaaaatgatggagcaaggtatgactgacgaagtaagaagcatgttcaatccaaaaaacacagattataccaaaggcatacgtaaagcaattggcgtaccagaattcgatagttattttcgagctgaattatcaaattctgttgacgtggagacgcgcgagaggctactaaaagaagctattaatgaagtgaagatcaataactgtatactagcaagtaagcaactagagaaaataaagagactcataaatgttaagggatggaaaattcaaagattagatgcaacagaagtttttaggaggaaacagagaaatgcagaggaagaagccgaggaaatttggaagaatatggtgatgggacagagcataaagattgtgggtaaatttttatgcgaaaataatcggagcaaaatggtttacagaaatgatgtgacagccattaagagagcagcagcgtcggccatagctcaatattag

SEQ ID NO: 62 - protein, 319 aa, Artificial Sequence
  Description of Artificial Sequence: Synthetic polypeptide
MRNSSLMCKQVWPTLRNLPQKDKVVFVMGVTGAGKSRLSIDLATQFRGEIVNSDKIQVYKGLDIATNKITQEERCGVPHHLLGVIDPYKEFTTKNFCNMASLAVNSITDRGKLPIIVGGSNSFIEALVHDNSHNFRTRYDCCFLWVDVSMNVLNSFLYERVDKMMEQGMTDEVRSMFNPKNTDYTKGIRKAIGVPEFDSYFRAELSNSVDVETRERLLKEAINEVKINNCILASKQLEKIKRLINVKGWKIQRLDATEVFRRKQRNAEEEAEEIWKNMVMGQSIKIVGKFLCENNRSKMVYRNDVTAIKRAAASAIAQY

SEQ ID NO: 63 - DNA, 930 bp, Artificial Sequence
  Description of Artificial Sequence: Synthetic polynucleotide
atggaagctgctcaacaacaaaaccagcagcactatcttcaccaacaacatttatcaattggacaggtggcaaacaacattgaagatggtgttggtggtaatagcagcaaaaacaacagcagcagtttcatgtgcaggcaaagtagtacgaggtggacacccacaactgaccagataagaattttgaaggacctttactacaacaatggagttaggtctccaactgctgaacagattcagaggatctctgctaagttaagacagtacggtaagattgaaggcaagaatgtgttttattggtttcagaaccataaagctcgtgaaaggcaaaagaagaggcttattgctgctgctgccactgataacaacaataatatccccatgcaaatgagaggtgtttggagatctgctgatgatcccattcaccacaagtataacaacactacaggtattcactgtccatcagcttcttctcatggtgtactagcagttggacagaatggaaactatggttatggaactgtagctatggagaagagctttagggactgttcaatatcaccaggtggtaactccaacggatcaatgggtcatcaaaacattacatgggttggagttgatccctacacttctcatcaagcatacccttttcttgaaaagactaaacattttgatgaaaccctagacgattatgaggaactgcaacaagaagaagaaaattaccaaagagcctctgctttagaaactctcccactttttcccatgcacgaagagaacatttccagtttctgcaacatcaaacatgaatcttcaggcggattctacacagaatggtatcgttcagatgatcataacttggctgctgcggccagagcttctcttgaactcagtctcaactctttcattggcagatctcctaattccccttaa

SEQ ID NO: 64 - protein, 309 aa, Artificial Sequence
  Description of Artificial Sequence: Synthetic polypeptide
MEAAQQQNQQHYLHQQHLSIGQVANNIEDGVGGNSSKNNSSSFMCRQSSTRWTPTTDQIRILKDLYYNNGVRSPTAEQIQRISAKLRQYGKIEGKNVFYWFQNHKARERQKKRLIAAAATDNNNNIPMQMRGVWRSADDPIHHKYNNTTGIHCPSASSHGVLAVGQNGNYGYGTVAMEKSFRDCSISPGGNSNGSMGHQNITWVGVDPYTSHQAYPFLEKTKHFDETLDDYEELQQEEENYQRASALETLPLFPMHEENISSFCNIKHESSGGFYTEWYRSDDHNLAAAARASLELSLNSFIGRSPNSP

SEQ ID NO: 65 - DNA, 822 bp, Artificial Sequence
  Description of Artificial Sequence: Synthetic polynucleotide
atggaagctgcccaacaacaaaaccagcagcactatcttcaccaacaacatttatcaattggacaggtgacaaacaacattattgaagatggtgttggtggtaatagcagcaaaaacaacagcagcagtttcatgtgcaggcaaagtagtacgaggtggacacccacaactgaccagataagaatcttgaaggatctttactacaacaatggagttaggtctccaactgctgaacagattcagaggatctctgctaagttaagacagtacggtaagattgaaggcaagaatgtgttttattggtttcagaaccataaagctcgtgaaaggcaaaagaagaggcttattgctgctgctgctactgatagcaacaataatattcccatgcacatgagaggtgtttggagatctgctgatgatcctatccaccacaagtataacaacactacaggtattcactgtccatcagcttcttctcatggtgtactggccgttggacagaatggaaactatggttatggaactttagctatggaaaagagctttaggactaaacattttgatgaaaccctagtagacgattatgaggaactgcaacaagaagaagaaaattaccaaagagcctctgctttagaaactctcccactttttcccatgcatgaagagaacatctccagtttctgcaacatcaaacatgaatcttcaggcggattctacacagaatggtaccgttcagatgatcataacttggctgctgcggccagagcttctcttgaacttagtctcaactctttcattggcagatctcctaattccccttaa

SEQ ID NO: 66 - protein, 273 aa, Artificial Sequence
  Description of Artificial Sequence: Synthetic polypeptide
MEAAQQQNQQHYLHQQHLSIGQVTNNIIEDGVGGNSSKNNSSSFMCRQSSTRWTPTTDQIRILKDLYYNNGVRSPTAEQIQRISAKLRQYGKIEGKNVFYWFQNHKARERQKKRLIAAAATDSNNNIPMHMRGVWRSADDPIHHKYNNTTGIHCPSASSHGVLAVGQNGNYGYGTLAMEKSFRTKHFDETLVDDYEELQQEEENYQRASALETLPLFPMHEENISSFCNIKHESSGGFYTEWYRSDDHNLAAAARASLELSLNSFIGRSPNSP

SEQ ID NO: 67 - DNA, 291 bp, Artificial Sequence
  Description of Artificial Sequence: Synthetic polynucleotide
atggattcgaagagttttctgctactactactactcttctgcttcttgttccttcatgatgcttctgatctcactcaagctcatgctcacgttcaaggactttccaaccgcaagatgatgatgatgaaaatggaaagtgaatgggttggagcaaatggagaagcagagaaggcaaagacgaagggtttaggactacatgaagagttaaggactgttccttcgggacctgacccgttgcaccatcatgtgaacccaccaagacagccaagaaacaactttcagctcccttga

SEQ ID NO: 68 - protein, 96 aa, Artificial Sequence
  Description of Artificial Sequence: Synthetic polypeptide
MDSKSFLLLLLLFCFLFLHDASDLTQAHAHVQGLSNRKMMMMKMESEWVGANGEAEKAKTKGLGLHEELRTVPSGPDPLHHHVNPPRQPRNNFQLP

SEQ ID NO: 69 - DNA, 396 bp, Artificial Sequence
  Description of Artificial Sequence: Synthetic polynucleotide
atgtgtattccatatcttgatccgtttgtttcttactcacttatagatcaacaacttgcatctactgcatttctgttcgcttctgaaatgactaatttcactgccaaacgtttcaccctcttcctcttgctgtgtgttttggttgtgcaagaatctcatgggtgcactagtagctcaaaatgcatttcacaaaaggaagttgcttctgtgagaatactaaacagaaaggttttaggaagccagcgggctgcttttggaaagggcttaaatggaaactacaatcattcagggaagattaatgacaagtttgctgattgggagcttaggggaattccagctggtcctgatccattgcaccacaatggtgctaatccgaagaaaccccggactccataa

SEQ ID NO: 70 - protein, 131 aa, Artificial Sequence
  Description of Artificial Sequence: Synthetic polypeptide
MCIPYLDPFVSYSLIDQQLASTAFLFASEMTNFTAKRFTLFLLLCVLVVQESHGCTSSSKCISQKEVASVRILNRKVLGSQRAAFGKGLNGNYNHSGKINDKFADWELRGIPAGPDPLHHNGANPKKPRTP

SEQ ID NO: 71 - DNA, 1158 bp, Artificial Sequence
  Description of Artificial Sequence: Synthetic polynucleotide
atgttaggatcctttggttcatcatctcaatctcatgatgaagaagctgatgatcaacggcggagatgcagttccacttcccctgcaatccaaatccggcaactactcattagctgcgcggagttaatctcacggtccgatttctcggcggcaaacagactcctcaccattttatcaactaactcttccccttttgccactaatttcttgacacctaatgcatcatctaatgttgttgaaagttcaaatgattcagctctacttcagtcatcctatctttccctaaaccaagtgaccccttttattagatttagtcagctaactgctaatcaagcgattttagaagctattaacgataaccaacaagcgatccacatcgttgattttgatattaatcacggtgttcaatggccaccgttaatgcaagcactagctgatcgttaccctcctccaactcttcggattaccggtactggaaatgacctcgatacccttcgtagaaccggagatcgtttagctaaatttgctcactctttaggccttagatttcagtttcaccctcttttgatcaccaataataatgacaatgatcatgacccttcaatcatttcttctattgttcttctccctgatgagacattagcaatcaactgtgtattttatcttcacaggctcttaaaagaccgcgaaatgttaaggatttttttgcataggattaaatccatgaaccctaaagttgtaacactggccgagagagaagcaaatcataatcacccactttttttgcaaagatttgtggaggctttggattattatgcagctgtctttgattcattggaagcaactttgccgccgagcagtagagagaggatgacagtggagcaagtttggttcggaagagaaattatagatatagtagcagcagaaggagataagagaagagaaagacacgagagattcagatcatgggaagtaatgttgaggagctgtggatttagcaatgttgctttaagtccttttgcactttcacaagctaaacttctcttgagacttcattacccttctgaaggataccagcttagtgtttcgagtacgagtaattctttcttcttgggttggcaaaatcaaccccttttttccatatcttcttggcgttaa

SEQ ID NO: 72 - protein, 385 aa, Artificial Sequence
  Description of Artificial Sequence: Synthetic polypeptide
MLGSFGSSSQSHDEEADDQRRRCSSTSPAIQIRQLLISCAELISRSDFSAANRLLTILSTNSSPFATNFLTPNASSNVVESSNDSALLQSSYLSLNQVTPFIRFSQLTANQAILEAINDNQQAIHIVDFDINHGVQWPPLMQALADRYPPPTLRITGTGNDLDTLRRTGDRLAKFAHSLGLRFQFHPLLITNNNDNDHDPSIISSIVLLPDETLAINCVFYLHRLLKDREMLRIFLHRIKSMNPKVVTLAEREANHNHPLFLQRFVEALDYYAAVFDSLEATLPPSSRERMTVEQVWFGREIIDIVAAEGDKRRERHERFRSWEVMLRSCGFSNVALSPFALSQAKLLLRLHYPSEGYQLSVSSTSNSFFLGWQNQPLFSISSWR

SEQ ID NO: 73 - DNA, 1224 bp, Artificial Sequence
  Description of Artificial Sequence: Synthetic polynucleotide
atgttaggatcctttggttcatcatctcaatctcatgatgaagaaactgatgatcaacggcggagattcagttccacttcccctgcaatccaaatccggcaactactcattagctgcgcggagttaatctcgcggtccgatttctcggccgcaaacagactcctcaccattttatcaactaactcttccccttttggtgattcaactgaaagattagtccatcagttcactcgcgcactttctcttcgcctcaaccgttatatctcttcagccactaatttcttgacaccatctaatgttgttgaaagttcaaatgattcagctctacttcagtcatcctatctttccctaaaccaagtgactcctttcattagatttagtcagctaactgctaatcaagcgattttggaagctattaacgataaccaacaagcgatccacatcgttgattttgatattaatcacggtgttcaatggccaccgttaatgcaagcactagctgatcgttaccctcctccaactcttcggattaccggtactggaaatgaccttgatacccttcgtagaaccggagatcgtttagctaaatttgctcactctttaggccttagatttcagtttcaccctcttttgattaccaataataatgacaatgatcatgacccttcaataatttcttctattgttcttctccctgatgagacattagctatcaactgtgtattttatcttcacaggctcttgaaagaccgcgaaaagttaaggatttttttgcataggattaaatccatgaaccctaaagttgtaacgctggccgagagagaagcaaatcataatcacccactttttttgcaaagatttgtggaggctttggattattatgcagctgtgtttgattcattggaagcaactttgccaccgagcagtagagagaggatgacagtggaacaagtttggttcgggagagaaataattgatatagtagcagcagaaggagataagagaagagaaagacacgagagattcagatcatgggaagtaatgttgaggagctgtggatttagcaatgttgctttaagcccttttgcactctcacaagctaaacttctcttgagacttcattacccatctgaaggataccagcttagtgtttcgagtacgagtaattctttcttcttgggttggcaaaatcaaccccttttttccatatcttcttggcgttaa

SEQ ID NO: 74 - protein, 407 aa, Artificial Sequence
  Description of Artificial Sequence: Synthetic polypeptide
MLGSFGSSSQSHDEETDDQRRRFSSTSPAIQIRQLLISCAELISRSDFSAANRLLTILSTNSSPFGDSTERLVHQFTRALSLRLNRYISSATNFLTPSNVVESSNDSALLQSSYLSLNQVTPFIRFSQLTANQAILEAINDNQQAIHIVDFDINHGVQWPPLMQALADRYPPPTLRITGTGNDLDTLRRTGDRLAKFAHSLGLRFQFHPLLITNNNDNDHDPSIISSIVLLPDETLAINCVFYLHRLLKDREKLRIFLHRIKSMNPKVVTLAEREANHNHPLFLQRFVEALDYYAAVFDSLEATLPPSSRERMTVEQVWFGREIIDIVAAEGDKRRERHERFRSWEVMLRSCGFSNVALSPFALSQAKLLLRLHYPSEGYQLSVSSTSNSFFLGWQNQPLFSISSWR

SEQ ID NO: 75 - DNA, 1014 bp, Artificial Sequence
  Description of Artificial Sequence: Synthetic polynucleotide
atggggagagctccatgttgtgataaagcaaatgtgaagagagggccatggtctcctgaagaagatgctaaactcaaagatttcattcacaaatatggaactggtggaaattggattgctcttcctcaaaaagctggtctaaagagatgtgggaagagttgtagattgagatggctaaattatttaaggcctaacattaaacatggtgatttttctgaggaagaagatagagttatttgcaccttgtattccaccattggaagcaggtggtcaataatagcagctcaattaccgggaagaactgacaatgatatcaagaattactggaatactaagctcaagaaaaaacctatgggattaatgcaatcaactaaccaaagaaaatcaccatattttccagctactaattctcttcaaacccaaccccagataaattcaagtctttttagagacttatattacaccccaaataataggcctaatattacaggcctaaatcatcagtccatttcttctgcccaccagacaaattttctctacactaataataacatgaactttcctaatttgggtgctacaaataatcaatatccttataatatccaaagtcataatttacttatgtttggagaagcaagttgttcttcatcagatggaagttgcagccaaatgagttttggtaaagaaatcaagagagaagaaattatgagtaatagtttacaacaaggtcaaatttcaagtgttaatgcttttgaagaaaaccaccagaattttactcttgattatggcaatagtagtagtaattgggtggatcaaaaaccaaatgtgtattttggtactactactactcaagtacttcagtatgataatgttgaagaagttaagcagcagctaacaagttgtaccaatggcaacaatggtagtactattggatgtaacaacaacaacagtatgttcgtgttcaatgatgagaattataacaagtcaaatgagatagagatgttctattactga

SEQ ID NO: 76 - protein, 337 aa, Artificial Sequence
  Description of Artificial Sequence: Synthetic polypeptide
MGRAPCCDKANVKRGPWSPEEDAKLKDFIHKYGTGGNWIALPQKAGLKRCGKSCRLRWLNYLRPNIKHGDFSEEEDRVICTLYSTIGSRWSIIAAQLPGRTDNDIKNYWNTKLKKKPMGLMQSTNQRKSPYFPATNSLQTQPQINSSLFRDLYYTPNNRPNITGLNHQSISSAHQTNFLYTNNNMNFPNLGATNNQYPYNIQSHNLLMFGEASCSSSDGSCSQMSFGKEIKREEIMSNSLQQGQISSVNAFEENHQNFTLDYGNSSSNWVDQKPNVYFGTTTTQVLQYDNVEEVKQQLTSCTNGNNGSTIGCNNNNSMFVFNDENYNKSNEIEMFYY

SEQ ID NO: 77 - DNA, 1011 bp, Artificial Sequence
  Description of Artificial Sequence: Synthetic polynucleotide
atggggagagctccatgttgtgataaagcaaatgtgaagagagggccatggtctcctgaagaagatgctaaactcaaagatttcattcacaaatatggaactggtggaaattggattgctcttccccaaaaagcaggtctaaagagatgtgggaagagttgtagattgagatggctaaattatctaaggcctaatatcaaacatggtgatttttcggaggaagaagatagagttatttgcagcttgtattccaccattggaagcaggtggtcaataatagcagctcaattaccaggaaggactgacaatgatatcaagaattactggaatactaaactcaagaaaaagcttatgggattaatgcaatcaacaaaccaaagaaaatcaccatattttccagctactaattctcttcaaacccaaccccagataaattcaagtctttttagagacttatattacaacccaaataataggcctattattacaggcctaaatcagtccatttcttctgcccaccagccaaattttctctacactaatagtaacatgaattttcctaatttgggtgctacaaatagtcaatatccttataatattcaaagtcataatttacttatgtttggagaagcaagttgttcttcatcagatggaagttgtagccaaatgagttttggcaaagaaatcaagagagaggaaattatgagtaattgtttacaacaaggtcaaatttcaagtgttaatgcttttgaagaaaatcagaatttcactcttgattatggtaacagtagtagtaattgggtggatcaaaaaccaaatgtgtattttggaaatactactactactactcaagtacttcagtatgatgttgaagaagttaagcagcagctaacaagttgtaccaatggcaacaatggcagtactattggatgtaacaacaacaacagtatgttcgtgttcaatgatgagaattataacaagtcaaatgagatagggatgttctattactga

SEQ ID NO: 78 - protein, 336 aa, Artificial Sequence
  Description of Artificial Sequence: Synthetic polypeptide
MGRAPCCDKANVKRGPWSPEEDAKLKDFIHKYGTGGNWIALPQKAGLKRCGKSCRLRWLNYLRPNIKHGDFSEEEDRVICSLYSTIGSRWSIIAAQLPGRTDNDIKNYWNTKLKKKLMGLMQSTNQRKSPYFPATNSLQTQPQINSSLFRDLYYNPNNRPIITGLNQSISSAHQPNFLYTNSNMNFPNLGATNSQYPYNIQSHNLLMFGEASCSSSDGSCSQMSFGKEIKREEIMSNCLQQGQISSVNAFEENQNFTLDYGNSSSNWVDQKPNVYFGNTTTTTQVLQYDVEEVKQQLTSCTNGNNGSTIGCNNNNSMFVFNDENYNKSNEIGMFYY

SEQ ID NO: 79 - DNA, 495 bp, Bacillus amyloliquefaciens
atgaaaaggaatcagcttcacatgatgaaaatgggaggtattgctttgaaaaaacgattatcgtggatttccgtttgtttactggtgcttgtctccgcggcggggatgctgttttcaacagctgccaaaacggaaacatcttctcacaaggcacacacagaagcacaggttatcaacacgtttgacggggttgcggattatcttcagacatatcataagctacctgataattacattacaaaatcagaagcacaagccctcggctgggtggcatcaaaagggaaccttgcagacgtcgctccggggaaaagcatcggcggagacatcttctcaaacagggaaggcaaactcccgggcaaaagcggacgaacatggcgtgaagcggatattaactatacatcaggcttcagaaattcagaccggattctttactcaagcgactggctgatttacaaaacaacggaccattatcagacctttacaaaaatcagataa

SEQ ID NO: 80 - protein, 164 aa, Bacillus amyloliquefaciens
MKRNQLHMMKMGGIALKKRLSWISVCLLVLVSAAGMLFSTAAKTETSSHKAHTEAQVINTFDGVADYLQTYHKLPDNYITKSEAQALGWVASKGNLADVAPGKSIGGDIFSNREGKLPGKSGRTWREADINYTSGFRNSDRILYSSDWLIYKTTDHYQTFTKIR

SEQ ID NO: 81 - DNA, 1290 bp, Arabidopsis thaliana
atgaacaacaacattttcagtactactaccaccatcaatgacgactacatgttattcccttataatgaccattattcctcacaaccattgctcccttttagcccttcttcttccattaacgacatcttgattcactccacctctaacacatcaaacaatcatcttgaccatcatcatcaattccaacaaccttctcctttttctcacttcgaatttgccccggactgcgccctcctcacctctttccacccagaaaacaatggccatgatgataaccaaaccatcccaaacgacaatcatcatccatcacttcactttcccttgaacaacaccattgtagaacaacccactgagccctcggaaactataaaccttatagaagattcccagagaatctcaacttctcaagacccaaaaatgaaaaaagccaagaaacccagcagaacggacaggcacagcaagatcaaaacggccaaagggacacgagatcgtaggatgagactctcgctagatgtcgccaaagagttgtttggcttacaagacatgcttggatttgacaaagccagcaaaaccgttgaatggttgcttacacaagcaaaacctgagatcataaagatcgcgacaaccctttctcaccatggctgcttcagcagcggcgatgagtctcatatccgatccatggacacatcttctgatctatgtgaacttgcatccatgtggacggtcgacgatagaggcagcaatactaacacgaccgaaacaagaggaaacaaggtcgatgggagatcgatgagagggaagagaaagaggccagaaccgcgaacgcccattttaaagaagttgtccaaggaggagagagcgaaagctagagaaagagcaaagggtagaacaatggagaaaatgatgatgaagatgaaaggaagatcacaattagtgaaagttgtggaagaagacgctcatgatcatggtgagataataaagaataataatagaagccaagtgaatcggagttcttttgagatgacacactgcgaagacaagatcgaagaactttgcaagaacgatcgttttgcagtttgcaacgaatttatcatgaataagaaagatcacatttcaaatgaatcttatgacttagtcaactacaaaccgaactcatcattcccagtgattaaccaccatcgcagccaaggagcagctaattccattgagcagcatcagtttacggatcttcattactccttcggcgcgaaaccaagagacctcatgcacaactatcaaaacatgtattga

SEQ ID NO: 82 - protein, 429 aa, Arabidopsis thaliana
MNNNIFSTTTTINDDYMLFPYNDHYSSQPLLPFSPSSSINDILIHSTSNTSNNHLDHHHQFQQPSPFSHFEFAPDCALLTSFHPENNGHDDNQTIPNDNHHPSLHFPLNNTIVEQPTEPSETINLIEDSQRISTSQDPKMKKAKKPSRTDRHSKIKTAKGTRDRRMRLSLDVAKELFGLQDMLGFDKASKTVEWLLTQAKPEIIKIATTLSHHGCFSSGDESHIRSMDTSSDLCELASMWTVDDRGSNTNTTETRGNKVDGRSMRGKRKRPEPRTPILKKLSKEERAKARERAKGRTMEKMMMKMKGRSQLVKVVEEDAHDHGEIIKNNNRSQVNRSSFEMTHCEDKIEELCKNDRFAVCNEFIMNKKDHISNESYDLVNYKPNSSFPVINHHRSQGAANSIEQHQFTDLHYSFGAKPRDLMHNYQNMY

SEQ ID NO: 83 - DNA, 299 bp, Artificial Sequence
  Description of Artificial Sequence: Synthetic polynucleotide
atgtatccgccaagcaacagctgcaactacagccccattttcaacatcccttctccttgtatgcaatatggagacgaactattcttccaatattatcctgaccatttccttcaacagcaacaagtgcctttgatagaagatcagagtgttgacatcttagctgattgcactgagaatgttactaacgaagaaactgtcatcaatactgatactgtaaaagttctttatgacacaggagctgttacaaacagtcagtgttggggaggaaatgaagaagtagaagaaggccgcgaaaacaa

SEQ ID NO: 84 - DNA, 318 bp, Artificial Sequence
  Description of Artificial Sequence: Synthetic polynucleotide
atggctcgctccttgtgtttcatggcatttgcagtcttggcaatgatgctctttgttgcctatgaggtgcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgtttgatgagaagatgatcaaaacaggagctgaaacttttgctgaggaagcaaaaactttggctgcagctttgcttgaagaagagataatggataactaa

SEQ ID NO: 85 - DNA, 300 bp, Artificial Sequence
  Description of Artificial Sequence: Synthetic polynucleotide
atggcagggaaggttgagaaagtgcttgcagtagtgatgcttgcaatgcttctgttttcggagcatttaatggctgctaatcatgaaattaaaacaactgaagataactctactattagccctttctgcttagtaaaatgtttatttggatgtagggggttgccacctgtacaagcatccatttgtgctgctcaatgttatttaaagtgccgtgaccaagatgcggccaatattgctgaaactaagggcataattggtgagactgcatacaaccagtatgatgttggatgtgcccttggc

SEQ ID NO: 86 - DNA, 300 bp, Artificial Sequence
  Description of Artificial Sequence: Synthetic polynucleotide
atgtatccgtcaagcaacagctgtaattacagcctcaatatttcctcctcaaataacttatttcacattccatctccgaattctatgcaatatgaacacgaacttttccaatattttcatgaccatcatctccttcaaccccaacaacaacaacaacaacaacaactcttgactacacctgatcattatatggcagcagattccaacaaagacaccgtaatcagtagtactaatcaagatcctgaagaagttgaattacaaggccgctgcaagaacaaaaaaggtgacaataagagacgt

SEQ ID NO: 87 - DNA, 362 bp, Artificial Sequence
  Description of Artificial Sequence: Synthetic polynucleotide
atggaaaaggttcatgagaaaccgctatctctttataatggatcattatctgtttttagattaggagatttggctgtgaaaataacaaaggtgaaaaagggatcattaaataatgataatctttcacccccaacttcattgttagttgtttcaccaatcataccaggaacttatccagttttactcttttttcatggcttcgttctcaagcctatatggtacaagtctctccttcaacatatttcttcccacggctatatagttgttgctccacaggtttctcaaagcgaagaagtgaaaaaagcagccaaagttacagaatggttaagtaaagccctcgaatccgtactgccggagaaagt

SEQ ID NO: 88 - DNA, 300 bp, Artificial Sequence
  Description of Artificial Sequence: Synthetic polynucleotide
atgtgtttgttaataaaggtggcgaatccaggagaatccggcgagcatgacagaattccatcaacgggaggtgattcagaaagtacaactactaccacagaaggaggaattccgcagctatatgaacaattacaatcacaatcacaatcatttgaagaaatgttgcggcaacaaatacaacaagaaacagagtatttgatgtcttcatctgcaactcctatgttttcacggtatagtcagacaagggagatgtcggcaatggtaacggcgttaacgcatgtggtatcaggacggagagag

SEQ ID NO: 89 - DNA, 300 bp, Artificial Sequence
  Description of Artificial Sequence: Synthetic polynucleotide
atggcacatttcttctctataaattcaacgttagcaggaacgaataaagcatccaaaacaaatttcacatattcaactcaagaaacagaaaaaccaaaaataaagatcatcttactcttgttttctcttgcattagttcccttgtcagcgatggcaacttgcaccactgatactccaaaccaagcactattgagggatgtacacgatatagatggtaacccccttcaagtaaaagccaggtacttcatatttccagttattggcggtggtggtgtacggcttgctaatcttggagatcaa

SEQ ID NO: 90 - DNA, 348 bp, Artificial Sequence
  Description of Artificial Sequence: Synthetic polynucleotide
atggctgagcaacaccagcgccaccagcaacagcagcagcagcagcagatgcaagtgggccacccgacggaggcaatcaagagccttcttcctcaaaggggtccctctaaatcccaagtccttgctgtcgtcactctcttccctgttggtggggccctcctctgccttgctggactgacgctcgccggaactctgatcgggcttgcagtcgctacgccggttttcttactgttcagcccggttttggtccccgctgccctgacaatcgcgttggccgtcactggattcttgacttccggcgcctttggaataacggcgctgtcgtcgctctcgtggatcattaactat

SEQ ID NO: 91 - DNA, 300 bp, Artificial Sequence
  Description of Artificial Sequence: Synthetic polynucleotide
atgaacggtggttcatgtggtggtgctgatcgtgagtataataacaataacaacaataatgttgtaggtggaggaggtggcgggccttgtggtgcatgcaagtttcttagaagaaaatgtgtgaggggatgcatatttgcaccttattttgattctgatcaaggcactgctcatttcgctgctgtacataaggtgtttggtgctagcaatgcctctaaattgctgctcagaattccagcgcataaacgtctggatgctgtcgttacactttgctatgaggctcttgctagagttagagac

SEQ ID NO: 92 - DNA, 300 bp, Artificial Sequence
  Description of Artificial Sequence: Synthetic polynucleotide
atgtcggataaaaaatctgtctcgacgccatttgaatgttgcagaatcttgtttaagtttctgctgtttatggttattatcagtaatgtggcgatccatgtaacagctttgagtgggcgagaaggaataaccccaagtacggaatggggtttggggcctctggtgaagagaggagaaagaaaactagtagtttcaactgaaaatggggaggtctcttcagtcagagtagctgatggaatcaccggttcctatcatcttcagttcatcacattggagcccaattccctcttccttcctgtt

SEQ ID NO: 93 - DNA, 293 bp, Artificial Sequence
  Description of Artificial Sequence: Synthetic polynucleotide
atgggcgtaccagaatcggaggtggtgtcacaaggtgaggttgaatcaccattgcaaccagatcaaaaccagcacaagaaccatcagttcccgtccctcggtagacaagcatcgatctactccctcactctcgacgaattccaacacaccctatgtgaaagtggcaagaatttcgggtcgatgaatatggatgaattcctaacagcatttggactgctgaagaaaaccaagcccacgcacacgcccatgcccatgccgcgcacgggcatgcgcacgcgcattctcatgctcat

SEQ ID NO: 94 - DNA, 300 bp, Artificial Sequence
  Description of Artificial Sequence: Synthetic polynucleotide
atggaggaaaaagatgaacttgaggaagaagaagaatatgttgatgatgaaatcaagaacaatttaccagtccaaaactcatcttcaataagttggttcacaaaaatgatatctttacaagtagagatcttcaccactatcttagtttcccccattttctatatcctctcttttgtatctgacttcaacttcctccgccctgaagaaaccgaaaagaacgtagctgtagctgtaaatgctgctgctacagtaccttcaaaagtagtacatggaagtactttactgctcaagaaatttggt

SEQ ID NO: 95 - DNA, 300 bp, Artificial Sequence
  Description of Artificial Sequence: Synthetic polynucleotide
atgtataactcaagcaactacagctgtaattacaaccccattttctcatctaatttattcaacatcccttctccttgtatgcaatatgaacacgaacttttcttccaatattaccatgatcaacttcaacagaatcttgacgataccttagctgagatcagtactgagactgccattattaacacggcagattccagcaaagacgaggctataatcagtagaaatgaacttgaacaagatcaggaagcgcgtaagaataaaaagggtaaagtaagcagcaacaagagagtgtctaagaaa

SEQ ID NO: 96 - DNA, 300 bp, Artificial Sequence
  Description of Artificial Sequence: Synthetic polynucleotide
atgggaactggtacttatggagaagtgggacgtacaatacatcaaagatcaggaacacatatacctcaaattctcgatccgcctttgctaggggatagtgattgcaagcgagaaggcaaacatgtagaatttatgcctccaatcatgggtgaaaacttaaaagcagctaatcaatttgaactgatggccccgtcaattgcattcaaatcatatccctattcggaggtaccacaatattctggtggcaatgtggctgctgcatgtggtgaatctttggtacatcaaaatatagaaagatca

SEQ ID NO: 97 - DNA, 320 bp, Artificial Sequence
  Description of Artificial Sequence: Synthetic polynucleotide
aggacaaggttgtgtttgtgatgggagtcaccggcgccggaaaatcaagactgtcaatagacttagccactcaattcagaggagaaatagtgaactccgacaaaatacaagtgtacaaaggtcttgatattgccactaacaaaatcacacaagaagaacgttgtggtgtaccacaccatctcctaggcgtaattgatccttacaaagaattcaccaccaaaaacttctgcaacatggcttcacttgcagttaactctataaccgaccgcggtaaacttccgatcatcgttggaggttccaattcgtttatcgaggcgctt

SEQ ID NO: 98 - DNA, 297 bp, Artificial Sequence
  Description of Artificial Sequence: Synthetic polynucleotide
gaagatggtgttggtggtaatagcagcaaaaacaacagcagcagtttcatgtgcaggcaaagtagtacgaggtggacacccacaactgaccagataagaatcttgaaggatctttactacaacaatggagttaggtctccaactgctgaacagattcagaggatctctgctaagttaagacagtacggtaagattgaaggcaagaatgtgttttattggtttcagaaccataaagctcgtgaaaggcaaaagaagaggcttattgctgctgctgctactgatagcaacaataatatt

SEQ ID NO: 99 - DNA, 339 bp, Artificial Sequence
  Description of Artificial Sequence: Synthetic polynucleotide
tctaatgttgttgaaagttcaaatgattcagctctacttcagtcatcctatctttccctaaaccaagtgactcctttcattagatttagtcagctaactgctaatcaagcgattttggaagctattaacgataaccaacaagcgatccacatcgttgattttgatattaatcacggtgttcaatggccaccgttaatgcaagcactagctgatcgttaccctcctccaactcttcggattaccggtactggaaatgaccttgatacccttcgtagaaccggagatcgtttagctaaatttgctcactctttaggccttagatttcagtttcaccctctt

SEQ ID NO: 100 - DNA, 480 bp, Artificial Sequence
  Description of Artificial Sequence: Synthetic polynucleotide
actgacaatgatatcaagaattactggaatactaagctcaagaaaaaacctatgggattaatgcaatcaactaaccaaagaaaatcaccatattttccagctactaattctcttcaaacccaaccccagataaattcaagtctttttagagacttatattacaccccaaataataggcctaatattacaggcctaaatcatcagtccatttcttctgcccaccagacaaattttctctacactaatagtaacatgaattttcctaatttgggtgctacaaatagtcaatatccttataatattcaaagtcataatttacttatgtttggagaagcaagttgttcttcatcagatggaagttgtagccaaatgagttttggcaaagaaatcaagagagaggaaattatgagtaattgtttacaacaaggtcaaatttcaagtgttaatgcttttgaagaaaatcagaatttcactcttgat

SEQ ID NO: 101 - DNA, 900 bp, Artificial Sequence
  Description of Artificial Sequence: Synthetic polynucleotide
atgaattcaaagaaaaacaactcaccaagaaaaaggttgagaaaatatcatacaagaaaagctcctattattagctcttatatggacatggctgaagctagaagagaaattgttcatgctttacaacttcatcgatcttcatcttcatctccaactccgtctattaatagcccaaagaagtacacattattgggtcaaggagttgtaagctctcaacaatattactattactcaatagtggaatctatgcctattcctgaaccaacatggtctacaacggctccggcaatacttaatgcaatgggaactggtacttatggagaagtgggacgtacaatacatcaaagatcaggaacacatatacctcaaattctcgatccgcctttgctaggggatagtgattgcaagcgagaaggcaaacatgtagaatttatgcctccaatcatgggtgaaaacttaaaagcagctaatcaatttgaactgatggccccgtcaattgcattcaaatcatatccctattcggaggtaccacaatattctggtggcaatgtggctgctgcatgtggtgaatctttggtacatcaaaatatagaaagatcaatgtctgatccccttgtgattggtagagtgattggggaagttgttgattatttcactccaagtgttaagatgtctgttacttataacagcagcaagcatgtttataatgggcatgaactctttccttcctcagtcacctctaaacctagggttgaagttcatggaggtgatttgagatctttctttacaatgatcatgatagacccagatgttcctggtcctagtgatccatatctcagggaacacctacactggattgtcacagacattccaggcactacagattgctcgtttgggaaa

SEQ ID NO: 102 - DNA, 150 bp, Artificial Sequence
  Description of Artificial Sequence: Synthetic polynucleotide
caccacatagattgaacggagggaataatagtgtagccccattgggaaacaccatatttatataggtagaagaaatactccagatttaactagaatttctactgacaaaagatcttttacactatcaatcacttaaaagataactacagg

SEQ ID NO: 103 - DNA, 141 bp, Artificial Sequence
  Description of Artificial Sequence: Synthetic polynucleotide
cactaagctttcttttcctcataacctcacttgcttctcctttgttcttctttcgtctcctcctttgtttcgcctccccttgttctggtaactcttgagtgtagataccaggatagtactgagaaatgagtatcatttgat

SEQ ID NO: 104 - DNA, 150 bp, Artificial Sequence
  Description of Artificial Sequence: Synthetic polynucleotide
catgaaccaacacaataggaggcaaatcagtgttagtcttttttgaatcatctgttttaaggctagtttccaaatttggcttgaaaagccaatcgctcagagtctgggaaacatcaccggccactgaaacagctctgtcaattggaatgt

SEQ ID NO: 105 - DNA, 165 bp, Artificial Sequence
  Description of Artificial Sequence: Synthetic polynucleotide
gttatcacaattcacaagggaaagttcataacatgaccactgtcgaatcaaaaagggaaagttcatatataatacgcttaggctttgggtttttcaaatgaagggtagagttcttcataaacgaaattccacattgttacttcatatttcacatattcccgaata

SEQ ID NO: 106 - DNA, 153 bp, Artificial Sequence
  Description of Artificial Sequence: Synthetic polynucleotide
ttctccttatacctcctgagtaccataatttacactcatctatgtccaatgccttacatcccacccatctaatttcctgaacacaagctacactaatcttctaatgagcgcaaaatacaacacaaaattattgctcgctagtcaaagataata

SEQ ID NO: 107 - DNA, 180 bp, Artificial Sequence
  Description of Artificial Sequence: Synthetic polynucleotide
tgggacatttgatagttagacgttgtaactttaggttgaaatctgcagtcgagttcattgttctctttataataatcacttgaaactggttgctggctacacgctgctgttgcttcaacatgcagatatggcgctaccggccgtagtgcagatgtgggagtttccatttcaggcttggca

SEQ ID NO: 108 - DNA, 560 bp, Artificial Sequence
  Description of Artificial Sequence: Synthetic polynucleotide
attactcttaactttaaatagatttcttatatatgggttcaaaaatgtctgatccccttgtgattggtagagtgattggggaagttgttgattatttcactccaagtgttaagatgtctgttacttataacagcagcaagcatgtttataatgggcatgaactctttccttcctcagtcacctctaaacctagggttgaagttcatggaggtgatttgagatctttctttacaatgatcatgatagacccagatgttcctggtcctagtgatccatatctcagggaacacctacactggattgtcacagacattccaggcactacagattgctcgtttgggaaagaaatagttggctatgaaatgccaaggccaaatattggaattcacaggtttgtatttctgctgttcaagcagaagaagaggcaaacagtattgactgcacctctctccagggatcgatttaatacgcgtaaattcgcagaagaaaatgagcttgggtctcctgttgcagcagttttcttcaattgccagagggaaactgctgccagaaggcgttga

SEQ ID NO: 109 - DNA, 522 bp, Artificial Sequence
  Description of Artificial Sequence: Synthetic polynucleotide
atggctcaaatgacagatccccttgtgattagtagggtggttggagatgttgttgattatttctctccaagtgttaagatgtgtgttatttataaccccagtaagcatgtctataatgggcatgaactctttccatcccttgttacctctaaacctaaggttgaagttcatggaggtgacatgagatccttctttacactgatcatgactgaccctgatgttcctggtcctagcgatccatatcttagggagcacttacattgggtaattacagacattccaggcactacagattcctcgtttggaaaagaagtggtgggctatgaaatgccaatgcctaacattggaatccataggtttgtgtttctgctcttcaagcagaagaagaggcaaacagtgagcgcaccattatccagggaccgattcaatacgcggaaatacgcagaagaaaatgagcttggctctccagttgctgctgttttcttcaactgccaaagggaaaccgcggccagaaagcgttga

SEQ ID NO: 110 - DNA, 453 bp, Artificial Sequence
  Description of Artificial Sequence: Synthetic polynucleotide
atggctcaaatgagtacagatccccttgtgattggcagggtggttggagatgttgttgattatttctccccaagtgttaaaatgtctgttatttgtaaccccagcaaacatgtctataatgggcatgaactctttccatcctctgttacctctaaacctaaggttgaagttaacggaggtgacatgacatccttctttacattgatcatgactgaccctgatgttcctggtcctagtgatccatatattagggagcacttgcactggaaaagaattaagtggtgggctatgaaatgccaatgccaaataaaggaatccataggtttgtgtttgtgctgttcaagcagaagaaaaggcaaacagtatgcattatccagggaccgattcaataccaatacagctgctgctgttttcttcaattgccaaagggaaaccgcggccagaaggcgttga

SEQ ID NO: 111 - DNA, 3155 bp, Artificial Sequence
  Description of Artificial Sequence: Synthetic polynucleotide
aagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtggatcctgcaggctagcgtgcactctagactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactatgataaattatcgcgcgcggtgtcatctatgttactagatcgggaattcctcgagcaactatttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaggtaccaaacaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttttgagcgggactctggcgatcgccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggactagt

SEQ ID NO: 112 - DNA, 11801 bp, Artificial Sequence
  Description of Artificial Sequence: Synthetic polynucleotide
tgagcgtcgcaaaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgccagaaggccgccagagaggccgagcgcggccgtgaggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtagctgattgtcatcagcgcattgacggcgtccccggccgaaaaacccgcctcgcagaggaagcgaagctgcgcgtcggccgtttccatctgcggtgcgcccggtcgcgtgccggcatggatgcgcgcgccatcgcggtaggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcgttcaatcggaccagcggaggctggtccggaggccagacgtgaaacccaacatacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccagatctggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgaagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtggatcctgcaggctagcgtgcactctagactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactatgataaattatcgcgcgcggtgtcatctatgttactagatcgggaattcctcgagcaactatttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaggtaccaaacaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttttgagcgggactctggcgatcgccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggactagtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatatcaactcccctatccattgctcaccgaatggtacaggtcggggacccgaagttccgactgtcggcctgatgcatccccggctgatcgaccccagatctggggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaacttactgatttagtgtatgatggtgtttttgaggtgctccagtggcttctgtgtctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgcacccccgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccgg

SEQ ID NO: 113 - DNA, 2499 bp, Artificial Sequence
  Description of Artificial Sequence: Synthetic polynucleotide
tctaggagcaaaaaaaaaaaaaaaaaaaaaaacaagtagtagtagtagtagtaaatggaaaaatagagaggcaattttttttagtatcttactttatccattagcacttaaaaaacataggtttacatgctctcattgtcacgccaggccgctaattaaatggtacatttcatcatccccattttttggcctcatagttaattatcacaatttctgaaagcaacatcagaacaaccccacatttcttgtggtcctataattactgctagatagtccaaacccatctgcctatttagggcttgtgaatgaggattgaaaatggtagagaatatttgcaaaggcatcatgcatatatggaaaagactaaagagagagttagtgccttgcaaagcggattctcacagttgtagaaaaggactcaccattttcaagaatactcccggcatgaagatggacaatttaatataaaaaacaaagaaaatagtaattaagtgcgttgagatgaatgaaatttatccgctcttaattgaatatggggaattgaaagaaatttctgataataaattaatgagtcttacatgacgtggatccgacttaatctagtctatttaaactaagaatagataagaatagagaatatagacaaaagagaggctcattggctagggtttcaagggagttccttgaacataagtggcaagtacaagcacaaagccaatttccatggactaaagatgaataagatgtgtcgtgtggtatggtgggaaggtgaggaggtatggggtaattggagatgctaaacctctctaaaagctcttttgctccaaatatctaaatccatctctatcacttttggcgactgccccaaaatttgcaacttatgaattaaagttttaatatttttaagttaataaattctgaattaataatttaacatattcaataaactttttaaaacaaattacgtatataccatcaaactggctgcaccatgatcactttctaaactcacaatgacatatggatttaatcaggcacaaagtcatgttgatagaaagagatagtacggagaatgaagaaaaaaggtaggggagagagatggggtgagtggggaaaagatagggttctctttttagtgaaagcgacagggtctgagaaccctaggtcaaaagttgcataaacctctatacaggcttcttcactcccttactactaatatactctcattaaggcttgaggtttaattcattaaaattgtggtttaattattgtatcccctcaaacgaaataattgtccttgtcgaggttagacaatgttgcgtactattttcaaacgcagtcagccattattctcctatcctttacagtcgagattcaaagacagaaagtagcatgcaagctgttattaatttactttgattaggactttgccaagaaaatgaagaaccttttcttttttcttttaatttagttatcttacaacatgtaatttttcctagcaagcaaatacggtaacttttttttttattctcatttaatttgttggagctattgctactttgatgacttcaaccaaatcctggttggtaggcggagggtgctgacgatggaaactacccctcttgtccaaatacgataacctaaaaaatagaataatagcttattgtactgtgctgcaaaaattgcattgtcagtatacataattaaaatctattttgaatgtgtggagggcaaagaggggtgactggtctagggttgtagaaatcaggtgggagagagaatggtatttgtctctgtgtcagctgatatcacgtgaagaggcacaataagaagtccttcgtatccattcacttcccaaaaataccggcattactacaaatatagtactagcacttgctttctctatccccatctttgctatttcctttccctttccaactttttggctttagaattgcaaagatggagggaattgtggttctttgtatctgtaaaatttttcctccaagctccagttgtagctagcttaatgcgtggacgcgcgcgcacacactagaaatctgcaatctatatatatattcacaaggcactcacatatcaaaaaccacatagacattgtatagagagagctgtcgttctcaagcagaaaaaatgatatgatttcatcagcatgtggtcaaccaaatagttcaattctagtctttgcttcctctttctaattactgtataaatagagccacaaggacatagaattgagaaaataaaagacaataaaaacaaatctagctacttaagcgaatgatgatgactctctctcagtagtcttaactcttaatacccttgttttccttcttgtgctgcagtttgattggttaattaacctaatcaaaagatgttttaactgtgttttatccgtctttctcaagatctatcttagtcccaccacatagctccctcaagctacagctgcaaaatatatactatatatatatataacaa

SEQ ID NO: 114 - DNA, 2500 bp, Artificial Sequence
  Description of Artificial Sequence: Synthetic polynucleotide
tgacattgctttggtggtttaagttctcagccagtatatgcattgtcctaataggtctcacatggaagcagcactgagagttgtaagatacataaaagaagctcctggcttaggtctcttcttgcctgtaaaatcttcagatcaactaagtgctttttgtgactcagattggggagcatgtatacaaattagaaggttagttacagggtacttggtaaagtttgaaagtgctcttatatcctggaagtctaagaagcagagtactgtgtctaggagctctaatgaagctgagtttataagtatggcttcatgtgcagcagaagttacctggccggtaggactgttcagtgaacttggtgtcaaggttaaacttcctataaacttggtatgtgatagtaaagctgcaatccaaattgcagcaaatccaatcttccatgaaagaacaaaacatattgatatagactgtcactttgtaaaggaaaagctaagtctaaggatgctaaaaactgagtatgtcaacatgaggatcaactggcagatatacttacaaaaggattgtgaagagctcaacatgtacatttgctgaacaagctagggttgaagaatctgtatcaaccatcagcttgagagggagtgttaatcaacatggttaccactagtttatttataaagtgtaaatgctaaaccatagctagtgagttagttaatagttagttgagtttgttataaatattagtcagctgtacagtttaacatagcttctctttcagaaatgaaaattgctcttctctcatttcctctcttctagattcttcttctccctccttctcttagctcagatctctcttatgacagctaacaataaatacgaatatttcttgtaacggttgctcattgaatgttgtctttctcaaccgatatctttctttcaagttttccccccgattcgagtatttttgaaactcactcagcaccggtcacatattcgtaatcggtgccagctatttgcttactcatatcttatttgacttcattgtcacgtgtcagacagaagtatgtgcgcatataccatcaagtctcaatttgaaataaaatcaacttaagcagttaaaagtcaaatctcttttagttcggtctttaaaataataatttaaataatgaacctataaaacacgcaactcacactgaatataggggcagacataaaagccgaaagactgaattccgaaccggaccgaattatttcggtatttcgatatcggtttattcagtatttcggtactatttcggtataggatttttagttattcggtatttcggtacgatcctcggtattgaaatttcgatatttcggtataccgaaataccgaataatttaagtacaccttccttcactgcccagcccgttatcaattttcagcccaagtttctaacttgttatttctttcccttagccagtagcctactaagattaagcccaacgccccaacctaacattagaaattattataattagaaaagtataaagaaagtactcacattctactgctatgctcatgtagtgatttctattagaaattattagaagtgaaggtactgcccacattttcttgttgctatactcattatcacgcaattagaaattttctaatgaattagaattcagtagttcagcacagaggcggatgtagcgtattacctacgggttcaactgaacctataactttcgacacagagtaaaaatttatatgtaaaaattctttaaaattgtaaaaatcgtagatatgaacccataactttaaaaatataatgggtaacattaaaattgaacccatagaatttaaatcctggattcgcctctggttcagcattgtttagttcacaaaaatatggtacgatgccgaaccgtatcgaaaccataccgaaccaaacaagaagatatcgaacaataccgaactactttggtacagtatttggtatgcacacttgatatatcgaataccgaaataccgaaccgtaattttcgaataccgtaccgaaataccgaacactcacccataactaaacattaaaaagctagaactcaggtgtttaatgactaaacggaagtaagatctagataatccgtcactctgttgatttgtaaggctatcgacatgcaaaagtggaagcaaaatggagccgaaattttaacaaaaatgctgaaccaataccatgaaattgatgaatggtgggaccctatttcactcttttagaatttgcgtaagaccagaaaataacttcaatcgaaatcaaaataaataccaacccttttaggccccaaatcactacgtgtgatttgcaaacgtcattagccttatgtaaacagtgacctcatgccaacatattatcgcagcctataaatcttagtttacatttcattttctttcaaacacacacacctcacaatagaactaagttgtaagagtttcattttctttgttctttctcacaaaccaaa

SEQ ID NO: 115 - DNA, 2500 bp, Artificial Sequence
  Description of Artificial Sequence: Synthetic polynucleotide
tgccagacagtctaaaattcaaaaataggacagcccacatcccctccaccccactagatctcactacttcttaattaggacttgtgggggggagtagagggatttgcaaaggcggccgcggcatgcatatacggaaaagagaagttagtggtttgcaaagatgattgtggaaaagggcttacctaacaatgaagaagaggaagagggtagatggataataataactcaaaaatagaaagaagagggacaagtgggggctcaatggctaaggttttaagggaggtcttggaaacatcattagcaagtacatgcagtattaccaccctacatcagactgtggggtctgatggaatattcttctactatactcttttaaatagagggaattaatgagcctttataatgttgaaatttataagaaaatagtataactttttaaatctcttaattatgtatcaaatcaaatctcatatttaccctttagtggatctattcactgaagtctgaataaatcgtaccagtaattcataccgaatgtgtaaataatttgaaagaaagatagacaaggcctcaatgkctagggatttgttagcatcaatagcaagtataagcagaaatatataccaccaaggagtgaggtggaagaattaagatttactctaatgaaatatatatatcaagattgagtcatgtgaatgaagaatttcttagtaccttaaattaagcgaatatcacataacagaggtgtaaaaaaacgaaagatggacaagctaagtggctctcaatggctggggttttaagggatcggaggtcttgttaacatcagacggaagtacaattagagtatatatgctactctaataatacttggctacaaacataaaaaaatatctctatcactatctctcaactcgccatatagacttaattggcacaaagtcatgctgatggaaagagatataaggagaatgggaagacaaaaaaaaaagtggggatagaaagagtgtccaagtagctagaagggggtgggggtggggggtgggggagttgttgttttagttgtggaagagataggtttctctttttagtgaaagtgacatatatagctagactgagaaccctggtcaaaagttgctttgccttaacgtttctaaatgcctgacctctgagaggctatcttctcctctcattctctcgacccttactgttcatatacccccaaatttgaggtctaatttatccacactatggtttcttactgttgtcttcttctctgaaacaatattgcttgtcgatcttggacttggccacgtcaacgtgtaacttcagcaactagggtgactccaagtcatagacagatctaggtcgacttctgtgaatttaactaaacaaattatttaatttcgactcaaaatagatatgtactatatatatatatagtaaacttattgtgaacttactaacttaaaattttcaagtttgcagtattttttggaataagaaaggggaaaaagaggcagaaaaccccatatttcttcctctttggagttgacgctaaagggataaagctaacatgcaagctcttaacaaataacatactcagtataatctcacaaatggggtatagagaggataaaacgtacacaaatcttaacaatatacacagtgtaattccataagtgagttctgtggacggtagtagcttaccccttgcctttaacatgcaagctcttaagctttgtatttttattttgttctttctttttggagaggaagaagtggtggttgaagactagagataaggaagaaaagagaaggatttttgtcagttgctatcacgtgaactgaaggggcacaattagagagaagtctatatgcttcacttcccataaaatcagttgtaactacaacaagtactaagagtgtcccctccattttctttctttccctcaattccctttcatacttttaaagcttaattccacagctagaaaaagaagcctttctttttctctagaggtatttagcaaagatggaaggacaatattacagctctctttgtctctacaggtaacaaaccattgcctgtctttctcaatctccagtatttccagctatcttataatgctttgagtactcccacaaaacacatgcattatagccactagctacatatatatatatatttgtaaaaccacacattaatttagctgtcattctcaaccaaaaagctatgttatcatcaacatattgacaaattacctataattccttcccctctagctatatgatctatctcactttattatgcacttaaaaagttatgttgtccctctcaaaagtcttaattaattaaccttgttttgcatcttgctgcagctagctagcttattaaattgacaaactcagaagatgttgtggttctttcaacttcaataaaaagctaagagtagtacttgtgcttgtatatccgtccttctcaagctcaagtcccacttca

SEQ ID NO: 116 - DNA, 3433 bp, Artificial Sequence
  Description of Artificial Sequence: Synthetic polynucleotide
  modified_base (3171)..(3178): a, c, t, g, unknown or other
gttggagctaaaaataagagaaatggacaagtgtcaaattctagcgtccatggtagcgcgacgcactattgtggcgctagaaatagaagaccaaaatttccaatgttggcgtcgaccttgcgttgcggtattttttctatttcgctagggacaagattatttcaacaaaaggggttctaaacctaatttggaggatatctaacatactttgaaggcgaattcacgtaagggaatacaaaccacgcttggaaggggctttcaactagtttttcttctcttcttttctcttcctttcatctcattatgtattagttctagggttgttggtacttacattaacgttatagtttgaagcttggattatcttattattttatcatattggtttatttattcaatcttgcgcttgataatttaattttaattgattgatcaccaattaaatactatctacgaatttaggattgaaatcgggagagaaaattttagattgcatataggattgagtagagtaagatcttgaacctgaattacgagggaacgaatttgcgattaggatataaggatatacctaatcgtcttgcttggttactatacgggaattattaatacgttcttattaatcctaatccactggaatataggcgttgagttagcttgaacaggcgagtagtacttcgggagaatactacgagtaatattaaattgtcaatcaataaactagataaatttataagatagtttaagtaaaaaactcaatgagattgttagttgacccataactctgaaatattttctcccattagattgtctttaagcttgccggcatagtttttctagttttctagtttacaactctagattagttatagttaacaatcacactttagaaaatcgcttgagtagattaattgttaatttagttgatagttaatcataagtcatcgagggaacgatactctacttatcactttattacttatcgaccacgtatacttgagtgcgtttgggagcaacaaatttttgacgccgttgccgggacgttagttgatgttttcaactagtgaacaaaatgcaaatatgttatgcaattcggtgccatttacacgtctatgaggagttatattaaagaactttatgtaggatgttggttggatcctacaagctaaaattatggctaagaaaattgtgaattactaataaacttgtaataagataaaaaataatttcctagaacgtaatagaattgaagtgagattagaccgacacctcttcgtcggaaaactatgttatatatgtaggttattttatatatatatatatatatatatataattttcttggcgtttaattttttatattttgattcttcctactaataattctaactctatcactgaattaaacgtacaggattcatttcttatacaaaagaggttgatcattattaggtctgggcactgtcagaggctgaccgatatgagtagttcttcacatgcttggcagcaatttgaactgtgattgcttgaggggcgaaaaagagagtagaatctaagttcggtaatttttatctgaattctgtatttgtcttaaaaatttattgagtatgcataaaattattattttaaactcagtaatttaaaaaatttagaattcgaactcataaatttcaaattgggactccacctctgattgtttgtaagtggagtttaggggcagaactagctcaaaaagttcgggttcgattgaactcagtaaatttgattcaaagtctatatatttattgaaaaatcaactaaatatgtatatatacaataaatttcaaattcataaaaatttaaatcctgaattaacctaatagtaaaaccgcagactctaactagtggtctagtttagagagtcaaattatggtttttaacaaccttaaacaagcacaaatacttttccactattggttcaattttggttgttaacaaccttgattggtaattacgtacttgcatgggcatttgaaaattaagttacgtacgtgtaaaacgttttagagtagtccgtactaattaagaacacaaacactgcttgagattttgtggcggaagtttgttttgacttagcatgggtaggcccacgaattccccattttgaataaaagacaacctgtgctagtcgattagctattatttaattactagaatattacttactccctcctttttaatttagacgatttagtttgacttggcacaaagtttaaagaaaaaaaaaagacttttgaaatatgtggtgttaaaatcttaatgggcaaaagctaagtggagtcatgatatttgtgtgactataaaaacttctcattaagaataaagtgagtaaaataaaaaattaaagtcaaattatttctaaatatagaaatatatcattcttttttgaacggactaatacggaaagtgtgtcatttaaattaaaataaataaagtaatatttatcatatgattttaacatgtaaatatcatacaagtaatctaatcgtcaagcgcggatctaataaataagggacgggtattttgtttaggctgtgtatatataattttttaaaatctactaaaaaagaacaaataatagatttgtaaattagagggatatggtagaatctaactataaacccttaaagttcaaatcttgtatctgcttgtggtaatagtgtatatatattttttacacgtttttgttgtatagaactcaaactaaaaagggcattccagtgcacaaagcatctcctattcacacacaattcggtgaagggccgcactgtatgcaaggggtgtgatatcggcagtctatcctgatgcaagcatcaatggttgattccacggctcgaatccgttacctataggtcatacggagataactttaccgttactccaagtcccccttctacataaaacttgcatcaatagctgatttcacgactcgaacccataacctagttgatacgaagataactttaccgttgcttcaaggtccgtctacacaaaactgatcaaattattttcataaataaagaagctatcatttctctataaatagaactagagtccttgcatattccaacataagtatcagttccaggaaaatcaagacataatctgttagcttttctctttgccattctcnnnnnnnnatggattccttaccagtctcctccattgaatctctagtcattgagatcaagaaagagatgttctcaaaccaagaatttaacacttttgtcaccccaatatctgcctatgacactgcttggttggccatgatttcttataataatcaagaagaagccattaatggtcattctttttctggccctatgtttaagagttgtttaaattggattctcaacaaccaaaatgagcaaggattttggggagaatccaatggt

SEQ ID NO: 117 - DNA, 2512 bp, Artificial Sequence
  Description of Artificial Sequence: Synthetic polynucleotide
aagctggtacccttatgtttagtccaagaaaaataaccatacccaaatataagggtttgttgaagacggaaatatataaacaaataaacaaatatcatcatatctccgatagtttaaaattttagattggatatttcacacaatttatcaaaattttcaaaaaaaaattctactttttcttgcttggaacttggaaggggaaggggtggtggtggagatagggcggggcatcttctatctagtctatgtgattaatataacaaaacaaaaagggcgaggcaaaaacatggatgaatggtggtccttttctatatttatatggattgttacgatacgtcgatttcactttgcaaaataccaattagattcatttagttatctttttgatcactctgcttttactatcatatatatataggagtccttccacgtttcgcatgtgtcattgtttatattttccatggtcttccttccaaatggctaaaaaaatttgacacagtggtcccaaaagtttatagaaatagaattcaacagtgaggcatatacctatgaattctattttacatcttcatcgtataaaatagaatgtgttataaactttacctcgtgatgcttacaaggggtgaaaatataaaagcactttatagatttacaagagtcacaccttgatttatcctaagattttatttttttacatgccaaacaatgaagtatgggagatccaattggaataacatcaaatttaataaaattcgaaatagtcagagagctgtctactgaggtatattgaaacttatttttttttaatagaaaatatcaaatacttagcaatatattaaaatgtttcataaattacattgtttaaaccaagcgttgaaacatatgctgatacgaggtaggcttattgatgaatttataagggcctcattggaaaagacgatccaaagcaatgggctaaaaaattggcccattttctgccacccagtgtatggttattactagtttcacccacacagatttgcacttcattagaggacaatgttgctgaatttgaaacataagtccatttatctccactgtacagtccttcctggagtccaatcctgaccatatcttcatgattttatgtaatgtggtgaataagcaaagtttcatgttatgctttgtctcattttatagcaaattcatttcctcataaaatttacttcaaaaaagtttcgtttgattttcagaaatcaaaatatgcttttcggtaaccaaatggttttcaattttgtttacgaagaacttaaaactttccaacaccctacatctatgattgcaagttaaaattgcagaaatatgacactttttggagtggtctttatcgtttaacttcacttgcactttaagggcaaaagttaaaagtgtttccatgaagcaagcgagggataacacttattaaacttgaaattctactcatagaccaaaacaaggacaaaaattcaagactatctatgtgggtaaacgtacgaaaattgggcttctccagattagagccggaccttgtggaaagacagagaaattcgaggcccacttccagtttctaaggagattaagcctatcaaacgatggtccagaacgaaatatgtctttctttattctctactatatagctgactcagaatcgttagaatttgcaatttcctcataataaaatgtgaggcagtatagattcgaaaacctttgttgaagattattgactcagctacgcgaaacaaactgtagtatccaatgtaccgattaacaagcgactggttaactatgaatttgttagctcgacaaaatcaccggttaataatgagtttgtgagttcgataaaatctaattttctgatagaaattttatatattatgcagaaatttaataaaagtagacttaacttatatattttagcattgactcttttgaagtaaaatccattccatctaaattatgacttccctacatcgagtaagtaagttgcgtctgtatcctcattttacccacttttcgctatgcaattattcaaggatctttacacaaatagcaagccaatattaattatttattttttttagtcatatatataaattatacatatattatatacccattaattatttttaatttaagtgatagattggacgactatttggattaattcttcgttattcaagataatagatgtcgtctctaatacatgagctagaagataataaggattactaggccgaaaggctgatggaaatgaacaagaagataagctcctaaatggaaacagtacggaaaaagtcaaagagcagtgcatgggaggaatcatcagtcagaaaaggaagccacgtgtcaagtagaaacaagcacgtgtccatgcaaaagccacgtaactcccttccatcacatcttccttcttcaaaacctcgtgttttactctctcttttctcactgccagtgatcgtcaggactgtgcatgtttgtttaaaaactaaaggca

SEQ ID NO: 118 - DNA, 941 bp, Artificial Sequence
  Description of Artificial Sequence: Synthetic polynucleotide
tttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatccttttttactcattcagagaaacg

SEQ ID NO: 119 - DNA, 3013 bp, Artificial Sequence
  Description of Artificial Sequence: Synthetic polynucleotide
tttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatcctaatttactcaaacagagaaacgatgtatccgccaagcaacagctgcaactacagccccattttcaacatcccttctccttgtatgcaatatggagacgaactattcttccaatattatcctgaccatttccttcaacagcaacaagtgcctttgatagaagatcagagtgttgacatcttagctgattgcactgagaatgttactaacgaagaaactgtcatcaatactgatactgtaaaagttctttatgacacaggagctgttacaaacagtcagtgttggggaggaaatgaagaagtagaagaaggccgcgaaaacaaaagaaatgacatgagaagcaccattagtattattcatgtacggaaaaacaagaaatgttccaataaagatcgacatagcaagattaacactgctcgtggcctcagagaccgaaggatgagactttcccttgatgcagctcgcaagtttttcagtttacaagacatgttggggttcgataaggcaagtaaaactgtagaatggttgcttatcaaatcggagtctgaaatcgaagagctagccaaaggcaataaaggaggaggcattcctaaacaaagctgcagtactactaatggaattggtgcaattagtactgcaatatcctctatttctgagtgtgaggttatatcaggaactgatgaatctttctctattacttataaaaagaagctgaaaactgctaaaggagcctcgaaaaagacggctaaaactgctcgtagagctgcatttgatcgtcttattacaagggaaacgaggaatcaagcaagggctagggctagagagagaacaaaaataaagaaaagcctcggtaaatccaaagagaacagtgctgattactgtaatttggtggataattatggagattggagtcaatttagtatcttcaactatcagaaaaatgcagttggaatttcccatgatcaggtgggttcaataattaaacaacatgattttttaggatttcaataggctcgctccttgtgtaacatggcataagcagtcttggcaatgatgctctttgttgcctatggtttgtctccatttattcctctaataccccataaaaataataaaatataaattacatctacatgactggttttgaattatgataatgaacatgaagttacacttcttatgattttttcaagtacattgtgttttgattaccgcataaatatttaagcatggtcatcttttttttgattcatttgttgttagagtgactaattaatctgtagtatatgtctggaggcttgaggaatctgaaaaaatgtgcgtgtttgcatagttctttcaaaatagtataggacaatatattcttttaaaaaaaggagtccggtgcacaaagcatgtcgcattgttccgagtaaaagctgcacccaaagagtgtgatgcagacaacctactctaatacaagcattaatgaacgcgttgctccaaggctccggccccttcaatatatttctttatgaaccgtgaatttattcatgtttaaaagctttctttcaattccatcttttcttttgttctaacatttgttagtaaacgtgaatgaatgtagaggttcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgtttgatgagaagatgatcaaaacaggagctgaaacttttgctgaggaagcaaaaactttggctgcagctttgcttgaagaagagataatggataactaattagagattagaggaaaggattaattcagtgtcacacataataaagttgctgcctttcttaaaaggatagctaatgtattggcttttagtagcctttgttaccctaaaataagtgtgacatgtcaatccttttgatctagtaccaagtttatgtatgttttaatgaaaaatgatcttctatggtcattgcaatcccattatattccaagaacaaaacttcattattttcttggtcc

SEQ ID NO: 120 - DNA, 120 bp, Artificial Sequence
  Description of Artificial Sequence: Synthetic polynucleotide
tagcaatctttcttattattaaaattcctatccttttttactcattcagagaaacgatggctcgctccttgtgtttcatggcatttgcagtcttggcaatgatgctctttgttgcctatg

SEQ ID NO: 121 - DNA, 5668 bp, Artificial Sequence
  Description of Artificial Sequence: Synthetic polynucleotide
tttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatcctaatttactcaaacagagaaacgtctaggagcaaaaaaaaaaaaaaaaaaaaaaacaagtagtagtagtagtagtaaatggaaaaatagagaggcaattttttttagtatcttactttatccattagcacttaaaaaacataggtttacatgctctcattgtcacgccaggccgctaattaaatggtacatttcatcatccccattttttggcctcatagttaattatcacaatttctgaaagcaacatcagaacaaccccacatttcttgtggtcctataattactgctagatagtccaaacccatctgcctatttagggcttgtgaatgaggattgaaaatggtagagaatatttgcaaaggcatcatgcatatatggaaaagactaaagagagagttagtgccttgcaaagcggattctcacagttgtagaaaaggactcaccattttcaagaatactcccggcatgaagatggacaatttaatataaaaaacaaagaaaatagtaattaagtgcgttgagatgaatgaaatttatccgctcttaattgaatatggggaattgaaagaaatttctgataataaattaatgagtcttacatgacgtggatccgacttaatctagtctatttaaactaagaatagataagaatagagaatatagacaaaagagaggctcattggctagggtttcaagggagttccttgaacataagtggcaagtacaagcacaaagccaatttccatggactaaagatgaataagatgtgtcgtgtggtatggtgggaaggtgaggaggtatggggtaattggagatgctaaacctctctaaaagctcttttgctccaaatatctaaatccatctctatcacttttggcgactgccccaaaatttgcaacttatgaattaaagttttaatatttttaagttaataaattctgaattaataatttaacatattcaataaactttttaaaacaaattacgtatataccatcaaactggctgcaccatgatcactttctaaactcacaatgacatatggatttaatcaggcacaaagtcatgttgatagaaagagatagtacggagaatgaagaaaaaaggtaggggagagagatggggtgagtggggaaaagatagggttctctttttagtgaaagcgacagggtctgagaaccctaggtcaaaagttgcataaacctctatacaggcttcttcactcccttactactaatatactctcattaaggcttgaggtttaattcattaaaattgtggtttaattattgtatcccctcaaacgaaataattgtccttgtcgaggttagacaatgttgcgtactattttcaaacgcagtcagccattattctcctatcctttacagtcgagattcaaagacagaaagtagcatgcaagctgttattaatttactttgattaggactttgccaagaaaatgaagaaccttttcttttttcttttaatttagttatcttacaacatgtaatttttcctagcaagcaaatacggtaacttttttttttattctcatttaatttgttggagctattgctactttgatgacttcaaccaaatcctggttggtaggcggagggtgctgacgatggaaactacccctcttgtccaaatacgataacctaaaaaatagaataatagcttattgtactgtgctgcaaaaattgcattgtcagtatacataattaaaatctattttgaatgtgtggagggcaaagaggggtgactggtctagggttgtagaaatcaggtgggagagagaatggtatttgtctctgtgtcagctgatatcacgtgaagaggcacaataagaagtccttcgtatccattcacttcccaaaaataccggcattactacaaatatagtactagcacttgctttctctatccccatctttgctatttcctttccctttccaactttttggctttagaattgcaaagatggagggaattgtggttctttgtatctgtaaaatttttcctccaagctccagttgtagctagcttaatgcgtggacgcgcgcgcacacactagaaatctgcaatctatatatatattcacaaggcactcacatatcaaaaaccacatagacattgtatagagagagctgtcgttctcaagcagaaaaaatgatatgatttcatcagcatgtggtcaaccaaatagttcaattctagtctttgcttcctctttctaattactgtataaatagagccacaaggacatagaattgagaaaataaaagacaataaaaacaaatctagctacttaagcgaatgatgatgactctctctcagtagtcttaactcttaatacccttgttttccttcttgtgctgcagtttgattggttaattaacctaatcaaaagatgttttaactgtgttttatccgtctttctcaagatctatcttagtcccaccacatagctccctcaagctacagctgcaaaatatatactatatatatatataacaaatgtatccgtcaagcaacagctgtaattacagcctcaatatttcctcctcaaataacttatttcacattccatctccgaattctatgcaatatgaacacgaacttttccaatattttcatgaccatcatctccttcaaccccaacaacaacaacaacaacaacaactcttgactacacctgatcattatatggcagcagattccaacaaagacaccgtaatcagtagtactaatcaagatcctgaagaagttgaattacaaggccgctgcaagaacaaaaaaggtgacaataagagacgtgttgcttacaagaaagatagacacagcaagattaacactgctcacggccctagagaccgaagaatgagactttctctcgatgtagctcgcaaatttttcaatttgcaagacttgcttggattcgataaggctagcaaaactgtggagtggttgctaacaaagtccaaatgtgctgtcaatgagctcgtccaaggcataaataaagaaaattgcgctactgctaatattggtgcaattagtacatgctctactacatctgagtgtgaagttgtatcaggaattgatgaatctacaaccactaatgatattcagaagcagtcaaatagaggtaaagtaggggagaagaagaaggctaataaactagttcgtagagctgcatttaatcctgtggcaaaggaatcaagaaagcaagctagagcgagggcaagggagagaacaaaaataaagaaaagctttttaaatattggtgatcagtctatggcggctgatgatttaaaacgattaggatgttggagtctttttgaaacaggtgaagaatcaggtattcaaggtactaatcatcaaattgaagaacacaccacgcaccacgaggagcctcttttggggactaatgagaatgttgatgattgtaatttggttgttaccggcaactggaacccatataccatcttcaattatcaccacagtactgaaatttctcacgaggtaggttttacacttcatttaaatccaagagtaattcttttagagttcaagattctgatattttttttggtggcgagaccctttcttatatcaaagcaaccttcaaggtacatacaagattggataaaccaattctgagctcgctccttgtgtaacatggcataagcagtcttggcaatgatgctctttgttgcctatggtttgtctccatttattcctctaataccccataaaaataataaaatataaattacatctacatgactggttttgaattatgataatgaacatgaagttacacttcttatgattttttcaagtacattgtgttttgattaccgcataaatatttaagcatggtcatcttttttttgattcatttgttgttagagtgactaattaatctgtagtatatgtctggaggcttgaggaatctgaaaaaatgtgcgtgtttgcatagttctttcaaaatagtataggacaatatattcttttaaaaaaaggagtccggtgcacaaagcatgtcgcattgttccgagtaaaagctgcacccaaagagtgtgatgcagacaacctactctaatacaagcattaatgaacgcgttgctccaaggctccggccccttcaatatatttctttatgaaccgtgaatttattcatgtttaaaagctttctttcaattccatcttttcttttgttctaacatttgttagtaaacgtgaatgaatgtagaggttcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgtttgatgagaagatgatcaaaacaggagctgaaacttttgctgaggaagcaaaaactttggctgcagctttgcttgaagaagagataatggataactaattagagattagaggaaaggattaattcagtgtcacacataataaagttgctgcctttcttaaaaggatagctaatgtattggcttttagtagcctttgttaccctaaaataagtgtgacatgtcaatccttttgatctagtaccaagtttatgtatgttttaatgaaaaatgatcttctatggtcattgcaatcccattatattccaagaacaaaacttcattattttcttggtcc

SEQ ID NO: 122 - DNA, 210 bp, Artificial Sequence
  Description of Artificial Sequence: Synthetic polynucleotide
atgaattcaaagaaaaacaactcaccaagaaaaaggttgagaaaatatcatacaagaaaagctcctattattagctcttatatggacatggctgaagctagaagagaaattgttcatgctttacaacttcatcgatcttcatcttcatctccaactccgtctattaatagcccaaagaagtacacattattgggtcaaggagttgtaagc

SEQ ID NO: 123 - DNA, 1575 bp, Artificial Sequence
  Description of Artificial Sequence: Synthetic polynucleotide
atgattggatacccaaaacgtttcaccttgcatggcctttggccggcaaacagtactggatatagtctaaaatgtgctccacctccagagggtaccagcgtgtggacaacagacggacagttacggacagctcttcaaaaatgttggtatagtctgatccggggtcgtcccaattacatactgtggaaacatgaatggaaggattatggctattgctctagtcatacaataaaagatactgactacttctgggctgcagtacgaaagcatggaagaaacaccaagattgcgggcgatgcgattgttaacgaattgagtgatgcagaaatcagtccgtcaaatgataaggaaaggagatgcgagactgaaagcgatagcagccatcactaccaacattctgaacaccatcaacgaagatggctgggaagacgacgagaatgcgacaccaaacggtactcccaggcaaagtatatcacctcccctcacgaaagcgtgacggcttcacgcgaaaagagagcatccacatccacaattgaggaagcaccaccagcagtgaagaaactattattagagtggctgacaagcactataaacaatatattcgacaaacctgcccaaaaggagaatggcaacaccgcacaagcagatatcgtaacaactactggcgagcagcctcttcctcggacaggtaacacttaccccactatggacgcaggggctaagaaggcggaagccagggtgaacgacatattcgctgttaggcaatcgtctggcgagggactcagagacttcctcgcccgatttaacagggaagaaatccacaatgcctattgcgccaaggagagagccgacgatgatgaccttaacggtccaatccaacggctgacatcggttcaagaagaatcgagaagtgatcatcgtaatgatagtcaaagggatcagtcgggcccccgtctcagccgagaaagacatcaacactacgtcagaacaaccgtcctgccatctcctcgacacatggaagggccgcccaggccgtacatagggacacagcgaaacgaaagaggtatgcctccactcttatccactcacaatttttgtgtttctccttcaaaaatagtgtacgcactaaagaagctcggcacgatggtgaaatgtccacaaaagatgaagtccggcccaaatactcagaagttgaatgccatttgtgaatttcaccaggaacgaggtcacaaaaccgaggattgcataggtttgcgacaagaggtagtgagaatgttaaaccaagggaacttgaaagaactgatgagtgatcgcggacgagtcaactttgcccgtggacgcgaactaccccagggacctcctaagcctccctctccagctcgcactatccaaatgatcatcggtggaggcgacgaagctatgatcaaccatatgaagttcaccaccacgcataaattgaaacggtcgatgacccacgaacggtacgacgatttcggagacagtatcatcttcgataagtcagataccgacggtttgacttttccttattttgaagctatcgttattactttatga

SEQ ID NO: 124 - DNA, 1032 bp, Artificial Sequence
  Description of Artificial Sequence: Synthetic polynucleotide
atgagttgccagaacagtaaaacagaagaaacggccgacgagcaacacaataccagcaaagaccctaaacacaaacccttctttgacgtttacggccctcaggggagggcagatattgttttcaatcaaccggaatccaattcaactttgaatcttcaagacgtgcaaggtcttgtcacatgggtgcttgctgatgggttcatgccgtcatgggcttttatcaaaaacaagcctttgatccctaaagtggttatgctgtatgttcctggccttgatgccgctctatatttgtcacagtctaaagtgctcaaaggtttcaaagaatgctgtggtattccgaggccagttttagctctgagctgtgtatcagatggaaatcagacaatagatgcactccttacgtacaaatcaaagaggaaaaggaaagaagctgagcacatttcaccaataaacaccgagccttctgaacaaggtgctgagactcccactatggagcctctatcttttgttgacctcaaaaaggatataccatttcccatcagttattacacacttacggataaggaactagaagaaaatggatactgttatgaccaaccagaatttctttcgacgctccctgctccttcaggaacatctccacatgaaattttggcccttgactgcgagatggttctgctggataaattggtcaaaccatcaaacaacattgttgactacaatactaggtatagtggaattacttgtcagatgttggaggatgtgactaccactcttaaagatatccaggaggagttcttgaaactggtttacaaggagaccattctggttgggcattccttggaaaatgatttgttagccctgaagatcattcataatttggtaatagatactgctgtgttgtacaaacatccaagaggatcctacaaagctgctcttcgcgttctgagcagaaaatttctcggcagggagatacaggactcgggcaatgggcatgacagcattgaagatgcaaagctacactggaactag

SEQ ID NO: 125 - DNA, 2172 bp, Artificial Sequence
  Description of Artificial Sequence: Synthetic polynucleotide
atggcctccacctcctacatcaccttcaaaccccttcaacaaactcaactcaaactctattacttcactcactgcagtaagcattcttcaactctgtttcactcttcttttcatactctcctttctgcaccaacaaaatacacactggaaccaccaagaattttgccctccattcaagttaaagcacatgtcactcacttggaaacaagattgtcctttgaaccagagcaagaaatatcaggcagtagaactaataatgaaaatagttctgggttttcttcctttagtcccaaagataagatggttggcatgaaatcttcaagagaaaatttagataggcactgtcaaactttagatgaattggtgcaattgttcaagagcagtgcagaagcttctaatacaaaaagtgtgagaggcgaacaggaagatcatggaattaaagtgagtgaagaagtgaaacactatgcacttaaatatggttttaagatatatgagaagatgcggtcagagaaggtacaaatgaatgaagcaacccttacatctgttgcaagaatggcaatggcattgggaaatggtgacatggcatttgatgtggtaaggctaattaaagaatatggaataaacccgaggctgcgatcttatggtcctgccttatctgttttctgcaataatggggatgttgacaaggcatttatggttgaagaacacatgttggagcatggtgtctatccagaggaacccgaactggaggcacttttaaaagtaagtgtagaagctggtaggagtgagaaggtgtactatttgttgcataagcttcgagaaggagttcgacaagtctcaccttctactgcagatttgattgagaagtggttcaacagcaagatagcttcaagggttgggaaaagaaaatgggatgaaagaaccatacgcgaagctattaaaaatggaggtggtgggtggcatggacaaggctggttgggtaatggtaaatggactgtatcacacgcatatgttgactctgacggctgctgcaaatgctgtggtgagaagctggtgactattgatcttgatcctgttgaaactgaaaattttgccaagtcagttgcttctatagctgcgcagagagagagaaattcaagcttccagaaatttcaaagatggcttgactattatggaccctttgaagctattgttgatggagcaaatgttggcctttatagccaaagaaaatttaggccatctagggtcaatgctattgtcaacggaattcgccagatgcttccttcgaaaaagtggccgctgatagttttgcataatagacgtattactggagataagatggatgaaccattcaatagagcgtactggctgtatgcagctataaaatttaagtgcttaattgtgacgaatgatgaaatgagggaccatttgtttcaacttctgggaaatgactttttcccaaagtggaaagaacggcatcaggtgcatttcagtttctctgaaacaggtccagtacttcacatgccgcctccctgttctgttgtaattcagtcatcggaaagatttggaccagacagaaggatatatcatggacggagtagcagaactttgaaagataaagaactatcagggtctcgggattcaggatatcccaggttatcggattacaatttcaatatcaatttgatagagttggtttcagttatgagaaacatcaaggaagcaaggttcccgaaaccaattcgatcatactccagtcaaaaggatcattttaaaattaagcgtgtgttggttgatccaggtagttctgccaatattatccaactaagggtcttagaacaagcaaagctaatcgaagttccgacaatgaagcttctggccgggttcaacctaacaagcgtaacgacccaaggagagatcgtgttgcctacatatgctgaaggggtgacgaaatccaccttgttcaaagttgtggatggcgatatgggctacaatgtaattatcggtaggccatggatccacaaaataaaagttgtgccatcaacttatgatcaatttctaaattttcctacatcagacgggattaagcagattagaggtgatcaacctgctgcaagggaaatgaatgttgtcaccttatctagcagtaatgcggaggaaatcaacaaatag

SEQ ID NO: 126 - DNA, 468 bp, Artificial Sequence
  Description of Artificial Sequence: Synthetic polynucleotide
atgcagtcgccggaatcttgcgtcatagtgagttgcccaactactctaatagccgacgaagatgaagaggtggcagatatggagacatctgttaaggcagtggaggaaatcttgaattacaaattcattaaaccaaaacttcttgaagaagcccttacgcactcttcttgcattgattctgtttcttatcagcgccttgagttcgttggagagcaggcggagttccatggaggagcaatgaaggcgccgaaggttcttgctgatattgtggagtctgtggcggcagctgtatatgtggattgtggctttgatctgaagaatctctggctgcttcttctgagaacaaagaaaatgctaacttcacgctgcaaggctgcactccaaaagttagcttttaaatctattggtaagacggatctgaagttgaaccaaatacagagattgatggggcaagcaaaagctgcatga

SEQ ID NO: 127 - DNA, 705 bp, Artificial Sequence
  Description of Artificial Sequence: Synthetic polynucleotide
atgaaacctcaaaaatcattgttgatcaaggttcttattacacaatgtttgttagttctttgtgttgcacaacaggactttgatttcttctactttgttcaacagtggccagcatcttattgtgatacaagacgtagttgttgttatccgactaccggaaaacctgatgaagattttagcatccatggtctatggccaaactatgaaaatggtaaatggcctcaaaactgtgatcgtgaaagctctttggatgagtcaaagatctcagatcttataagtacaatggaaaagaattggccatcattggcttgcccaagtagcgatggtgtaagattttggagtcatgaatggctaaaacatggaacctgttctgctcttggtgaacgtgcttactttcaagctgctcttgacttcaggaaaaaatcaaaccttcttgaaaaccttaagaatgcagggattacaccaaggaatggagaacattacactttagaaagcattaaaaaggcaatagaagaaggagtaggacacagcccttacatagaatgcaatgtggatacacaaggaaatcaccagatttaccaagtttatctctgtatggacaaaactgcaacagattttattgattgcccagttttcccacatggccgaggatgtggttccaagattgaattccctcctttctcctctgaccatgatgaattttaa

SEQ ID NO: 128 - DNA, 654 bp, Artificial Sequence
  Description of Artificial Sequence: Synthetic polynucleotide
atggcaactagaagacgagaggctgactttgatttcttctactttgttcaacagtggccggcatcttattgtgacacaaggcgtagttgctgctatccaacaacgggaaaaccagatgaagattttagcatccatggtctatggccaaactatgaaaatggcaaatggcctcaaaactgcgatcgtgaaagctctttggatgaatcagagatctcagatcttataagtacaatggaaaagaattggccatcgttggcttgcccaagtagtgatggtgtaagattttggagtcatgaatggctaaaacatgggacctgttcagctcttggcgaacgtgcttactttcaagctgctcttgacttcaggaagaaatccaaccttcttgaaaaccttaagaatgcagggattaatccaaggaatggagaacattacactttagaaagcattaaaaaggcaatagaagaaggagtaggacacagcccttatatagaatgcaatgtggatacacaaggaaaccaccagatttaccaagtttatctgtgtgtggacaaaactgcaacagattttattgattgcccagttttccctcggggccgaggatgtggttccaagattgaattccctcctttctcctctgaccatgatgaattttaa

SEQ ID NO: 129 - DNA, 483 bp, Artificial Sequence
  Description of Artificial Sequence: Synthetic polynucleotide
atgggtgtcactacctataaccaagaggtcacaacactagttgccccaactaggttattcaaagctttggttcttgattctgaaaaccttgtcccaaaattgatgccacaagttgttaagaacattgagattgtagtgggtgatggtgatgcaggaagcatcaagaagatgaactttgttgaaggttctcctatcaagtacttgaagcacaagatccatgttattgatgacaagaacttggtaaccaagtattcactgatcgaaggagatgttttaggtgataaactggagttcgttacctatgatatcaaattcgaagcttcaggaaatggaggatgtatttgcaagacttcaactgagtaccacactaagggtgattatgtgtttaaagaagaagaacactatgagggcaaaaagcaagccatggaacttttcaagactgttgaagattacctcctcgcaaatccttccgtctatgtttga

SEQ ID NO: 130 - DNA, 483 bp, Artificial Sequence
  Description of Artificial Sequence: Synthetic polynucleotide
atgggtgttgcaatttttacccaagaatttacatcccctatagcaccaattcgtttgtttaaagctctaattgtggactcaaagtccctcatacccaaactcttgcctcaatttgttgagagtgttgatttgttacaaggagatggtggagctggaagtatcgaacaagtgaacttcacaaaaggtagtccttttgagtttgtgaaacatagaatagatgaactagataaagaaaatatggtgtgcaaatacactatgattgaaggggatgcattggcagataagtttgactctatttcttatgaagtaaaatttgaagagtccaataatggtggctgtatttgcaagatgacaactgagtatattggaattggtgattttatcgtcaaagaagaagatatcaaggctgggaaagatagtgcaattggcatatataaagctgtggaatctcacctccttcaaaatccaaacctttatgcgtaa

SEQ ID NO: 131 - DNA, 483 bp, Artificial Sequence
  Description of Artificial Sequence: Synthetic polynucleotide
atgggtgtcactacctatactcatgaggtcacaacatcagttgccccaactaggttattcaaagctattgttcttgattctgaaaaccttgtcccaaaattgatgccaaaagtagttaagaacattgagattattgagggtgatggtggtgctggaagcatcaagaagatgaactttgttgaaggttctcctaacaagtacttgaagcacaagatccatgttattgacgacaagaacttggtgaccaaatattcactgatcgaaggagatgttttaggcgacaaactggagttcgttacttatgagatcaaattcgaagcatctggaaatggaggatgtatttgcaaaacttcaactgagtaccacacaaagggtgactatgtatttaaagaagaagaacacaatgaaggcaaaaatcaagctatggaacttttcaagactgttgaagattacctcctcgccaatccttcggtctatgtttaa

SEQ ID NO: 132 - DNA, 483 bp, Artificial Sequence
  Description of Artificial Sequence: Synthetic polynucleotide
atggctatcacttccttcactgatgagtacacttgtcctattcctccatcaagaatctttaaagcctccattattgattctcacaatttgatgccaaagctaatgccacaagctattaaaagtattgaatttgttcagggtaatggaggtgctggaagtattaagcaaatcaactttcctgaaggtggcaattttaagtccattaagtataggattgatgagcttaatgaagagaaatttgtttacaaatacactttgattgaaggtgatgccttggttgataaactcgaaaaaataacttacgaggtgaagtttgagcagtcagcagatggtggttctatctctaaggtgacaagcacatattatacggagggcgatttcaagctcaaggaagaagaaattaaagcaggcaaagagaaagtcttaggaatgtataaagcagtagaagtctatctcctgcagaatcctgatgcatatgcttaa

SEQ ID NO: 133 - DNA, 690 bp, Artificial Sequence
  Description of Artificial Sequence: Synthetic polynucleotide
atggcttcaaattcggccacttctctgttcttgacactatttcttattatacagtgtttatcactccttactgctgctcaagattttgactttttctactttgttcaacagtggccagggtcttactgtgacactaaacaaagttgttgctaccccaaaactggaaaaccagcatcagattttggaatccatggactttggcctaataacaatgatggctcttacccatcaaactgtgattctaacagtccttatgatcaatctcaggtttctgacttaatcagcagaatgcaacaaaattggccaactctagcatgcccaagtggtactggctcagcattttggtcacatgaatgggaaaaacatggcacttgttctgaatctatttttgaccaacatggctatttcaagaaagctcttgatctcaaaaatcaaattaatcttttggaaattcttcagggtgctggaattaaccctgatggcggattttatagcttgaacagcattaaaaatgcgattaacagcgcaattgggtatactcctggaatcgaatgtaatgtagacgagtcgggtaatagccagttataccaggtttatatttgtgtcgatggctcgggttcaaatctcatcgaatgccctgtttttcctaggggaaaatgtggctccagcattgagttcccaacattttaa

SEQ ID NO: 134 - DNA, 690 bp, Artificial Sequence
  Description of Artificial Sequence: Synthetic polynucleotide
atggcttccaattcagccacttctcggttcttgacactatttcttattacgcagtgtttatcagtcctcactgctgctcaagattttgactttttctactttgttcaacagtggccaggatcatactgtgatactaaacaaagttgttgttaccccaaaactggaaaaccagcatcagattttggaatccatggactttggccaaataataatgatggctcttacccatcaaactgtgattctaacagtccttatgatcaatctcaggtttctgacttaattagcagaatgcaacaaaattggccaactctggcatgcccaagtgatactggctcagcattttggtcacatgaatgggaaaaacatggcacttgtgcagaaaatgtttttgaccaacatggttatttcaagaaagcacttgatctcaaaaatcaaattaatcttttggaaattcttcagggtgctggaattaaccctgatggtggattttatagcttgaacaatattaaaaatgcgattagaagcgcggttggttatactcctggaattgaatgtaatgtagacgagtctggtaatagccagttataccaggtttatatttgtgtcgatggctcgggttcagatctcatcgaatgccctgtttttcctagaggaaaatgtggctcgagcattgagttcccaacattctaa

SEQ ID NO: 135 - DNA, 723 bp, Artificial Sequence
  Description of Artificial Sequence: Synthetic polynucleotide
atgaggtccatccaacttgttttggtcaagcttgttatctttcaatgtatcatgttattacatgctcaggattttgatttcttctactttgctcaacagtggaatccagcatcatgtgacagcaagataaaatgttgctacccaacaaatggaaaaccagcacaagattttggtattcatgggctctggccaaattacaacaatggctcatttccaaaaagctgtaacaaaaatgcccgttatgatgaaacgcagatttcggacttgataagtagtatgcagaagaattggccgacactatcttgtccatcaaacaatggaacaaggttttggtctcatgaatggaagaaacatggtacttgttctctttctatgctagatatgcattcttatttccaagctgctcttgccttgaaggaaaaggtgaacctgcttcaatttctcaataatgcaggtattaaaccagatggaggattttacagctatgaagcaatgaaagaagcaatagaaaaaggcattggacatactgttggtgtagaatgcaatattgatttatttgggaatcgccagctttttgaggtttatgtgtgtgttgataaatgtggttcggaaatcattgactgcccaattgtcccagaaagtaagagatgcaaagaaagtattgaatttgctgtcttcgaatcagaaagtctccttgatgagaaatctgcctattcactctag

SEQ ID NO: 136 - DNA, 798 bp, Artificial Sequence
  Description of Artificial Sequence: Synthetic polynucleotide
atgagatccatcaagtttgtcttggtcaagctcgttatctttcaatgtataacgttattagtacatgctaaggacttagatttctaccgccttaccctacagcagtggaatccagcagcatgctacaataggattataggtaaatgctgtaacacaaccacgggaagaccagcagaagattttggtattgctggactatggccatcttacaacaatctcacatatccagaaaactgtaataaggcaggcccttatgatgaaacgcaagtaagttttgataaaatacagatctcggacttgctgagtagtatgcaaaagaattggcccaaaatatcttgtccatcaaacaatggaactagtctgtgggctaaggaatggaaggaacgtggtacttgttctaggctcaacatgcattcttatttcgaaacagctcttgatcttaaggaaaagctgaacctgattcaagatgttaagcgttacggtacagatcttacacatgtgcatatgcatggactcgaaccaaatggacaattttaccactggcgtcacatcaatgcagccataaaattagctattggacatgtgatcgctatagaatgcaatcttggtttaactgcggacagccagttttacagggttcacatatgtgttgataaatctggttcggacttcattgactgcccaattaacctcaccgaaatctctgagacaacatgttcttcatctactaaatggtctggctacgatacagatagtgtccttgaagagcgatctgcctattcttgggcaaggaaataa

SEQ ID NO: 137 - DNA, 1482 bp, Artificial Sequence
  Description of Artificial Sequence: Synthetic polynucleotide
atggggtcctttagttttgcagtatgtgttagcttaatgttgctggttatggtggttgctattccttttgaacccaaaaatggcagaaggatagggcggctgcaccgctggtgggaccccttaatacgatcgccggtagatcgtgatgatgaggtggaagacagcaatagtgttcgttgggcagttcttgttgctggttcaaatggatacggaaattatcggcatcaggcagatgtatgtcatgcttaccagattttgaaaagaggaggattgaaagatgagaacatagttgtattcatgtatgatgacattgccaaaagtgagctgaatccaaggcctggagtcataatcaatcatccaaatggcagtgatgtctatgctggtgtgccaaaggactacactggtgagcatgtcactgctgcgaatctgtatgctgtgcttcttggtgataagagtgctgtgaaaggtggaagtgggaaggtcatcgatagtaaaccgaatgacagaatatttctctattactctgatcatggtggtccaggggtcctcgggatgccaaacatgccttttctttatgccaaagattttattgaggccttgaaaaagaagcatgcagcagggacctacaaagaaatggtcctctacattgaagcttgtgagagcgggagtgtttttgagggtatgatgcctgaagacttgaacatttatgtgacaacagcatcaaatgccgacgagagcagctgggggacgtattgcccaggaatggatcctccacctccaccagaatatatcacatgtttgggagacttgtatagtgttgcatggatggaggatagtgagtctcacaacctgaagaaggaaacaataaaacaacagtacgagaaggtgaaggaaagaacttccaacttcaacaactataatgctggatctcatgttatggaatatggaagcaaagaaattaagccagagaaagtatatctgtaccaaggatttgatcctgccactgcgaatcttcctgcaaacaagattgattttgcgcacttggaggttgtcaaccagagggatgctgatcttctcttcttatgggagagatacaagaagctagcagacaattcattggagaaggccaagcttcggaaagagataacggacacaatgctgcatagacaacatctagacgggagcgtagatgcaattggagtctttcttttcggcccaacaaagggttcttctgttctcaactctgttagaaaacctggtttacctctcgttgatgattgggattgcctaaaatcgacggttcgccttttcgagctacattgtggctcgctaacacaatacgggatgaagcacatgagagcatttgcaaacatttgcaacaatggagtgtctagagatgctatggaggaagcttttatggctgcttgcaatgagcataagatagaggagtatatcgctgccaaccggggcttcagcgcttga

SEQ ID NO: 138 - DNA, 1485 bp, Artificial Sequence
  Description of Artificial Sequence: Synthetic polynucleotide
atggggtcctttagttttgcagtatgtgtaagcttaatgttgctggttatggtcgttgctattccttttgaattacccaaaaatggcagaaggatagggcggctgcaccgctggtgggaccccttaatacgatcgccggtagatcgtgatgatgagtctgaagacaaggacggtgttcgttgggcagttctcgtggctggttctaatggatacggaaattatcggcatcaggcagatgtatgtcatgcttaccagattttgaaaagaggaggattgaaagatgagaacatagttgtattcatgtatgatgacattgccaagagtgagctaaatccaagacccggagtcataatcaaccatccaaacggtagtgatgtctatgctggtgtgccgaaggattacactggcgagcatgtcactgcggcgaacttgtatgccgtgcttcttggtgataagagtgctgtgaaaggtggaagtgggaagatcgtcgatagtaaaccaaatgacagaatatttctctattactctgatcatggtggtccaggggtgctcgggatgccgaacatgccttttctttatgccaaagattttattgaggtcttgaaaaagaaacatgcagcagggacctacaaagaaatggtcctctacattgaagcttgtgagagcgggagtgtttttgagggtatgatgcctgaagacttgaacatttatgtgacaacagcatcaaatgccgaagagagcagctgggggacgtattgcccaggaatggatcctccacctccaccggaatatatcacatgtttgggagacttatatagtgttgcatggatggaggatagtgagtctcataacctgaagaaggaaacaataaaacaacagtacgagaaggtgaaggaaagaacttccaacttcaacaactataatgctggatctcatgttatggaatatggaagcaaagaaattaagccagaaaaagtttatttgtaccaaggatttgatcctgccaccgcgaatcttcctgcaaacaagattgcttttgcgcacgtggaggttgtcaaccagagggatgctgatcttctcttcttatgggagagatacaagaagctagcagacaattcattggagaaggccaagcttcggaaagagataacggacacaatgctgcatagaaaacatctagacgggagcgtagatgcaattggagtctttcttttcggcccaacaaagggttcttctgttctcaactctgttagagaacctggtttacctctcgttgatgattgggattgcctaaaatcgacggttcgccttttcgagctacattgtggttctctaacacaatacgggatgaagcacatgagagcatttgcaaacatttgcaacaatggagtgtcgagagatgctatggaggaagcttttatggctgcttgcaatgagcgtaagagagaggagtataccgctgccaaccggggcttcagtgcttga

SEQ ID NO: 139 - DNA, 2307 bp, Artificial Sequence
  Description of Artificial Sequence: Synthetic polynucleotide
atgtacgatgatattgctaacaatagcgagaaccccagacctggagtcctcatcaataacccacacggtcaagatgtttatcaaggtgttcctaaggattatgtgggtgaagatgttaatgctgacaattttttcaatgttatacttgccaacaaaagtggtatcactaggggtagtgggaaaattttggacagtggcccaaatgacaatattttcatctattatactgatcatggtggccctggaattgtctcaatgccaactggaattgtctatgcgaacgatctgattaacgtgttggaaaagaagcatgcttctgggacatatagtaaaatggtattttacttggaagcttgtgagtcgggaagcatgtttgatggtcttcttcccgaaggtctaaatatctatgtcacgactgcatcaaaaccagatgaaaacagttggggaacgtattgtggtttgggtcgtggtgcttgtttagttgagtgtcctcctcccgagtttgacggtgtttgcttgggagacttgtacagtgttgcttggatggaagacagtgatgtccaagatcgacaaacttcaacgttggataaccagtatgacaggattgcatgcagaactgcagccaacctaacatatggttcccatgtcatgcaatatggtgatatggagttaagtgttgatgctcttttccagtatatgggttctgtttccacaagccatagtcaagctcccagtcccatggcagctgctcccagtcccatggatgccgcgtcattcttgacatcctcagaaaatgtgaaccaacgtgacactgaacttttctacttgacatccaaataccaaggtgctcctgaaggcactaacgaggaatttgcagctgatcggaagcttaatgaggttgtagcacaaagaagtcaagtggataacaacgtaaaacgtcttggagagcttctgtttggagtcgaaaaaggtaatgaggtgctgcagagtgttcgacctgctggacaaccacttgttgacgattgggattgccttaaatcctatgtcaagacattcgaggcacactgtggaaaattaaccgcgtacgggaagaaacatgtacgtggtatcgccaacatatgcaatgctggaattgagagtgaggagatggttgatgcaactgcacaagcatgttcagccgcctctgaaatcggccctaactctcctacttttactcaaactgattttattttacctccttctcacccactctatcttcatccttctgacaatcctgaccccgatatttcacaaagtgttatatactctaagtctgctaagagactatgggataaattgaaccaaaggtatgggcaagcaaatggtgctaagatgtatgaagttcaaaaagacctaagcactatatttcaaggttcttctgatgtaggaagttatttcactagggttaaaagactccaggatgaaatggagtcacttgatgctgattccttttgtgtttgcgaatgcaaatgtggaggtaaacacaaaatgatcaaaaggatggaaaatcagaaattgatgcagtttttgatgggtttgaatgaggagagaggatatgatccaaaaatgccatattgtagatattgtaaaaagccaggacatgtaattgagaagtgctataagttacatggatttccacgaccttcaaaatcagggaacaagaatatccgagttgctgcacatgtccattcatcttctgatgctaagcctaacaggtcttatgacaataacatcaatattgccaacaccatcatacctgatcaatacaagcagcacatgactatccttcaacatattcaagttggttctaatgattctcaaagccaatttgccacagctaattttgcaggtatttttgcttcatctgcccatctgatgagttgtggtaattgtacttgtttaagtagtgttctaacttctgaaacctggatactagattctggaacatcagttcacatgacatttaacaaatattcgcttacaaatataacaactttatatgttccctacctcatcacattacccaatgggtataaagtcaaagtgaccacaattggttctgtcaaattaaactcttcagtcattttgtccaaggtgctatatgtgcctacttttaaatacaatctcattttagtccataagttattagttgatactttatcattgctatgtttttctcaacatgcatgttttctactacatggcccttctctgaggatgccattgatacttggtaagtgtcacaacccaaaatctcacccatcgtga

SEQ ID NO: 140 - DNA, 1374 bp, Artificial Sequence
  Description of Artificial Sequence: Synthetic polynucleotide
atggttcaaaaaaatggtgttgtttcattcctagttgtactttttgtcatagtttgtactgctgagggtcgtaacttgttggagagtattgttgaagatgataatgcgactggaactaaatgggctgtgttggtagctggatcaaatgagtgggataattacagacaccaggcggatgtatgccatgcatatcaactactgaagaaaggaggtctaaaagatgaaaacatcatcgtattcatgtacgacgatattgcttataataaaaacaaccctagacctggagtcatcatcaatagcccccacggccatgatgtttataaaggagtccccaaggattacacaggaaaagattgtaatgctgataactttttcgctgttatcctgggaaacaagagtgctctaactgggggcagtggaaaagttgtggaaaatggtccaaatgattatatatttatctactacgctgaccacggtgctcctggccttattggtatgcctagtggagatgatgtctatgccgacgatctgatcaaagtcctgattaaaaaacacacttttgggatatattccaaattggtattttacatggaagcttgtgagtctggaagtatgtttgatggtcttctcccaaaaggtttgaacatttacgtaacaacagcatcaaagcctgatgagggcagttgggctacatactgtatttctttaggtgatgaagatgtagtctgcttaggagacttgtacagtgttgcttggttggaggatagtgatttgcacgatcggcaagttgaaactttggagaaacagtatcagctggttcgtaagagaactctaaataatggtacagtcgaaggctcccatgtcatgcaatatggtgatttacatataagtgaggatcctcttttcagatatatgggttctaattctgcaaaaaatagttactatagtacttctaccaacgatgagtcatggctaccctcaaggactgttaatcagcgcgatgttcatctcatgcacttatggtctaagttccggtctgctcctgaaggctctgctagaaaaactgaagctcaaaggcaattaagggaagctatatcacaaagagaacacgtagacaacagtgtgagacatattggagaagttttgtttggagttgagaaaggtcccgaggtgctgcagactgttcgacctgctggacaacccctcgttgatgattgggactgccttaaatcctttgtcaagatatttgagtcacaatgtggaaagctaactccctacggaaggaaacacgttcgtggctttgctaacctgtgcaatgctggaattcgaagggagcaaatggctgcagcagctaaacaagcatgtccttcttaa

SEQ ID NO: 141 - DNA, 1080 bp, Artificial Sequence
  Description of Artificial Sequence: Synthetic polynucleotide
atgattcgaaaaaatggtgttgtgccattcctagttgcactttttgtcctagtttgtactgctgagggtcgtaacttgctggagagtattgttgaagatgataatccgactggaactaaatgggctgtgttggtagctggatcaaatgagtgggataattacagacaccaggcggatgtatgtcatgcatatcaactactgaagaaaggaggtctaaaagatgaaaacatcatcgtattcatgtacgacgatattgcttataataaaaacaaccccagacctggaattatcatcaatagcccccacggccatgatgtttataaggagtacccaagtgggaaggttgtggaaaatggtccaaatgattatatctttatctactacgctgatcatggtgctcctggccttattggtatgcctagtggagatgttgtctatgccgacgatctgaacagagtcctgattaaaaaacacacttttggaacatattcaaaattggtattttacatggaagcttgtgaatctggaagtatgtttgatggtttactcccgaaaggtttaaacatatacgtaacagcagcatcaaagcctgatgagagcagttgggctacctactgtattcgtttaggtgatgaagatcaatgcttaggagacttgtacagtgtttcttggttggaggatagtgatttgcacgatcggcaagttgaaactttggagaagcagtatcagctggttcgtaagagaactctaaacaatggtacagaagaaggctcccatgtcatgcaatatggtgatttacatattagtgaggatcctcttttcagaatatgggttctaattctgcaaaaaatagttataatacttcataacaacgacgagtcatggctaccctcaaggactgttaaccagcgcgatgttcatctcatgcatttatggtctaaggtcaagatatttgagtcacaatgtggaacgttaactccctacggaaggaaacacgttcgtggctttgctaacttgtgcaatgctggaattcgaagggagcaaatggctgcagcagctaaacaagcatgtcctccttaa

SEQ ID NO: 142 - DNA, 1062 bp, Artificial Sequence
  Description of Artificial Sequence: Synthetic polynucleotide
atgataccggcaagaatggctgatgtatgtcacgcttaccaattactaaaggatggaggtctaaaagatgaaaacatcatcgtattcatgtacgatgatattgctaataatagggagaaccccagacctggagtcattatcaataacccacatggccatgatgtttacaaaggtgtccccaaggattatgtgcttgaagatgttaatgctaacaacttttacaatgttatccttggaaacaaaagcgctgtagttgggggcagtgggaaagtagtgaacagtggtccaaatgaccatatcttcatctattatactgatcatggtggccctggtgtggtttcgatgccaagtggagaagatgtttacgctaatgatctgattgatatgttgaaaaagaagcatgcttcagggacatatgacagactggtgttttacttagaagcttgtgagtccggaagcatgtttgatggtcttcttcctgaaggtctagacatatatgtcatgactgcatcagaacctaatgaagatagttgggcgacgtattgtggtgagggtactcctgatgatccctgcttggttgagtgtccccctcccgagtttcagggtgtgtgcttgggagatttgtacagtgttgcttggatggaagatagcacaattgatagacttctttttcttacaccacacgatttctattcatttttttctgaatgtttgcagcaccaaaatgcccctgaaggctctgatgagaaattcaaagctcatgcgagacttactgaagctatatcacagagaactcaagtggacaacaatgtaaaacatcttggggagcttctttttggtgttgaaaaaggtaatgagatactacacagtgttcgacctgctggacaaccacttgttgacagctgggattgccttaagtcctacgtcaagatatttgaggcacattgtggaagattaacctcgtatggaaagaaacacatacgtggtatagccaacatctgcaacgctggaattgcgagtgaacaaatggctgctacatctgcacaagcatgttcaagttag

SEQ ID NO: 143 - DNA, 1452 bp, Artificial Sequence
  Description of Artificial Sequence: Synthetic polynucleotide
atgattgttcgctacgttgtgagtgctgtcttgatcattggactgtcaattctcgccgccgttgagcagggatgtgctgaaattaccgtcggaagcattaaagttttcagtggtgagtacgatgatgattcaattggtactaaatgggctgtgctggttgctggatcaagaggttgctggaattacaggcaccaggcagatgtttgtcacgcatatcagctgttgaagaaaggtggcctcaaggatgaaaatattattgtgtttatgtatgatgacattgctcataatcctgagaatcctaggccaggagtcatcataaatagccctaatggtcatgatgtctataaaggagttccaaaggattatacagggcatcatgttacagccaacaacgttcttgctgttatccttgggaacaaaagcgctcttagtggaggcagtgggaaggtggtggaaagtggtccgaatgatcatatcttcatcttctacagtgatcatggtggtcctggagtgcttgggatgcctagtggcccttatctctatgctgatgatttaattgatgccttgaaaaggaagcatgcttcagggacatacaaacgcttagtcttttacattgaggcttgtgaatctgggagtatatttgagggccttctacctgaaggtcttaatatctgtgcaacaacagcatcaaatgctgaagaggacagttggggaacctactgtccaggagactatccaggtcctcctccagaataccagacctgcttgggtgacttgtacgctgtgtcttggatggaagatagtgaaaaacacaatctccaaagagaaactttaggaatgcaatatgagctggttaaaaggagaactgccaactcgtttccctatgcaagttcccatgtaatgcaatatggtgatctgaagctaatggatgatcctctttccctttatatggggaccaatcccgcaaatgataattacacttttctggacgagaattcctcactgctctctgcaaagcctgttaaccaacgtgatgcagatcttttgcatttctgggacaagttcctcaaggctcctcaaggttctattaggaaaattgaagcccagaagcagctgactgaagctatgtcacacagaatgcacatagacgacagcattgcacttgttgggaagcttctattcggaattgagaaaggtcctgaggtgctgattagagtcagacctactggcgagcctcttgttgatgattgggattgtcttaaatcctttgtaagaacatttgagacacattgtggatcattatcccagtatggaatgaaacatatgcgtgctgttgctaacatatgcaactctggtataaaaatggagcagatagccaaagcatcagcacaagcttgtgtgagtattccttccaactcttggagttcgctcgacgagggatttagtgcatag

SEQ ID NO: 144 - DNA, 474 bp, Artificial Sequence
  Description of Artificial Sequence: Synthetic polynucleotide
atgagctatggtgaccaatcacaaactattggtgaccttgcttttgagaaattcacatttccttctatttttggaaataatgttaacattcttgatgttgtctttggctgcggtcatgacaatagtggcacgttcaacaactatacttctgttattattggcttaggtggtggtgaagtttcaattgtcaaccaattggataaagaaatcaatggaaaattctcttattgtttaatcacaattccattacaatcatcaatttctaatgccaccagtcacataaattttgatgcagatttagagttgtcgccttcgagcacgtttgcagaagtggaggaagatttggtttctcttacaatagtgccagcagaggaagttgccatttttggaaacttggagcaggcaaatttcctaattggatatgatcttgttgccaacaaaatctcctccttgccaacagactgcactagctaa

SEQ ID NO: 145 - DNA, 867 bp, Artificial Sequence
  Description of Artificial Sequence: Synthetic polynucleotide
atgattaatagtcgacaccgtcgaaaatatggaagtaaagatgaatggaatatgcgatttgggatttatcaatccaatgttcaatttatcgacttcttcaattccctcaacctttcttacaacctcactgacaatgcttttgcagatatgacaaacctcgagtttaattctaaatatttaggttataagaaacgtaaacattcaaagcaattagcagcaccaaatatcacgtgtgacagctctaaattgcctatcagtgtcgattggagaaagagtggagttgtaacacgagtcaaggatcaagaaaattgtggaagctgttgggcattctctgcagtagcagcagttgaaggcataaacaagatcaaaacagggaaattagtgtcactatcagaacaacaactagtggactgtgatgttttctcagacaaccaaggatgtaacggaggattcatggaaaaagcttttgctttcattaataaaaacggtggcattacaactgaaaaaaattatcattacgtaggaaaagaccagaaatgtaacactaccaaagcaaaacaacatgcagttacaataagtggctatgaaatggtagccaaaaatgaggaatctcttcaagctgcatttaccaaacaacctatatcagtggccattgatgcaagtggctatgattttcagctttgcgctggtggggtttactctgtttttttcggaaatagcctaaatcatggagtgccattaattggctatggtgtagatgatggtgagaaatattggctagttaagaattcatggggtactatgtggggtgaagatggttatatcaaaattaagaggtggtcaaatgacaaaaaaaggaacgtgtag

SEQ ID NO: 146 - DNA, 2121 bp, Artificial Sequence
  Description of Artificial Sequence: Synthetic polynucleotide
atggccaattctctcctctcttccaacttcatgggttctcaaatctttgtctctcctcccacccctaaaacaacaaagtatttccattttcactccaaaagaaagtctttaatccctcaatcaattctcaacaaaaaacccaattcagataattcaaagaatattccttcaaaagctgctttagctgctttactcttttcttcaatcactccacatgcctatgctcttgataatactacccctacagtaccaacccctcaagtgattcaagctgaagcagccaatcccaccacttcaaatccattctctcaaaatataatcttgaatgctccaaagcctcaagcacagaccaatcctgaacttccagaagtttctcaatggagatacagtgagttcttgaatgctgtaaagaagggtaaagttgaaagagtcagattcagtaaagacggaactacccttcagcttaatgctgttgatggccgtagagctagtgtaattgtgcctaatgacccggatttaattgacattttggctatgaatggtgttgatatatcagtttctgaaggtgattctggtggtaatgggttgtttaatttaattggaagtttattcccttttattgcttttgctggattgttctatcttttccagagatctcaaggtgggcctggtgggcctggtgggcttggtgggcccatggattttggtagatcaaagtccaagtttcaagaagttcctgaaactggagtgtcttttgctgatgttgctggtgctgatcaagctaaattggagttacaagaagtagttgattttttaaagaatcctgataagtatacagctttaggtgctaaaataccaaaagggtgtcttttggtggaccacctggtacaggaaagacacttttggctagagcagttgctggtgaagctggtgtaccatttttctatgtgcagcatcagagttgttgagttgtttgttggtgttggagcttctagagtgagggatttgttcgagaaggcgaagtcgaaagcgccttgcattgtgtttattgatgagattgatgctgtgggaaggcagagaggtgcaggaatgggaggtgggaatgatgagagagagcagactattaatcaactcttgactgaaatggatggtttttctggaaatagtggagtaattgttttggctgcaaccaataggcctgatgttcttgattctgcattgttgagacctgggaggttcgatcgacaagtgactgtcgacaggcctgatgttgctggtagaatcaagattcttcaggtgcattctagaggaaaggcccttgcaaaggatgtggactttgagaagattgccaggagaacaccgggtttcactggtgcagatttgcaaaacttgatgaatgaagcagcgatccttgcagctaggcgtgaactaaaggaaataagtaaagatgagatatctgatgctttggagaggataattgctggaccggagaagaaaaatgctgttgtctcagaggagaagaagaagctggtagcttatcatgaggccggccatgccttggttggtgcacttatgcccgagtatgatcctgttgccaagatatctattattcctcggggccaagctggtggtcttaccttctttgcccctagcgaagaaagacttgagtcgggcttgtacagcaggagctacctagagaatcaaatggcagttgcacttggtggaagggttgctgaggaggttatttttggacaagacaacgtaacaactggggcatctaacgatttcatgcaagtttcacgagtggcaaggcagatggttgagagattagggttcagcaaaaagatcggacaggttgccattggaggaggtggaggaaatcctttcctaggtcaacagatgtcaacccagaaagactactccatggcaacagccgatgtggttgatgctgaagtaagggaattggttgaaagagcatatgaaagggcaacacagattatcacaacacacattgacatcctacacaagcttgctcagctgttgatagagaaagaaactgttgatggtgaagagttcatgagccttttcatcgatggcaaggccgagctatacatttcatga

SEQ ID NO: 147 - DNA, 2238 bp, Artificial Sequence
  Description of Artificial Sequence: Synthetic polynucleotide
atgattatagaggtgctcatattgtggcatgcagatgttaggcataatatatctctaactgcactcagctctactcagtccttttacaaagatgacctttacattgttttcttgaaagatcatccggtgaacgaagaatcgctatttcagagacatattattgtcctatcatctttaaagggaagtgatggggctgcaacagaatctcatgtttatagctatacaaaaatcttcaatgcatttgcagcaaagctatctcaacatgaagttcacatgttatccagcatggatgaagtggtttctgtcataccaaacagatacaggaagctacatactacaagatcatgggaatttattggtttgcctgcaactgcaaaaagaagattgaaaagggagagcaacattatcgtgggtgttttcgatacagggataactcctcaatcaaaaagctttaaggatgatggtcttggtcctcctccagtaaaatggaaaggaagttgtggccattttgcaaatttttctggatgcaacaacaagcttataggagcaagatacttcaagctggacaaagttcctgatccaaatgacatattgtcaccaattgatgtgcacggccacggaacacatacatcatccaccctagcgggaagtatggtgcctgatgcaagcttgtttggtcttgcccgagggactgcacgtggagcggttccttctgctagagtggctatgtacaaagtctgttgggtgacctcaggttgtgcagatattgacattctagctgcatttgaagctgcaattagtgatggtgtggacttaatatccatctcaattggtggtctcagtggtagttatacaactgatgtgatagccattggatcatttcatgccatgagaaaagggattcttactgtggcttctgctggaaatgatggacctaacctcaacaccgtcgcgaaccatgcaccatggatgctaactgtagcggctagtggcattgatagggagttcaggagtaaggtggcgttgggaaatgggagaatagtctcagggattggagttagcgcgtttgatccaaagaaaaaattgtatcctcttacggcgggagtggatatggccaagagctctgacactcgagacagttcaaggtactgtggtgaaggatcaatggatcctagaaaggtaaagggaaagcttgtttattgccagttgggtacttggggtgctgattctgttataaaagaacttggagggatcggcactatcattgaaagcgatcagtttcttgattctgccccaattttcatggctcttgcaacaatagttaattccagcatagggaaaaacattaataactatatgcattcagagagattaccttcagcagtaatatacaaatcacaggaagttaagatcaaagctccatttattgcatcattttcatcaagaggtccaaatccaggaacaatacgccttctgaagcctgatattgcagctccaggaattgacattctggcttcttacacccccctgaaatcactcactggtttgaaaggcgatactcaatattcagaattcaccctcatgtctggcacttccatgtcatgccctcatgttggcggtgcagctgcttatgtaaagtcataccatccagattggtctccttctgctattaagtctgccctcgtgactactgcaagacctatgagctcaaaggtggacagggaagcagagttcgcgtatggtgctggacaagttaatccgacgaaagcaagaagtcctggattaatttatgacatggatgatatgtcatatatccagttcttatgccatgaaggttacaattcatcatcagtatccagtttacttcgacaacgggtaaattgctccacattgattcctgcaaatggtgaagatgctatcaactatcccacaatgcagcttggcctaaagagtaatcaagaaccaaccattggcattttcaggaggaaagttaccaatgttggacaagctatatctgtttataatgccactatcagagctcctaagggagtggatatcacagtaaaaccaacgactctctcattcacacgtgcaatgcagacaagaagtttcaaggttgttgtgaaggcaaaaccaatgtcaaatgctgtaatattgtcaggttcactcatttggaagagctcccgccatcttgtaagaagtcctattgtcatatatgatccaaaggtttttgattaa

SEQ ID NO: 148 - DNA, 5000 bp, Artificial Sequence
  Description of Artificial Sequence: Synthetic polynucleotide
aaaaatatgagaatcgtgcggaatttcagttttatggaactaaaacgccaaaaatggaggaacggtcatggagaggcgataactaatgttccttaggtttttttagatgggccgaaaaaattttaggcgatacgggtaaggcgtccgaaacacacgaaaatttgaaaatcgggcgaattcttgttttatgacactacaacaccaaaaagtatggaagattatggcgatgcgatgcgatgaataatgttccttaggttatttttgatgggtgacaacattttaggttatacgagaccgggttcccgggcccacaccagtggcgtgggctatattgcacacgaaaatatgggaatcgagcgaatttctacatttatggcactaaaatgcaaaacaaaaaggaacagtcatggcgaggcaatgactaatgttcctagggttatttagatgggccggaaaagttttaggtgatcctggtcgtggcgctcgagcccacgatggtagtgtgggcacacgaaaatctgggaaccgtgctgaattctagttttatggccttaaaacaccaaaaccaacaaagaggaattctcatggaggggcgatgaataatgttccttaggttgttttagatattccagaaagattttaggtgatccgggttgcggtgcctgggcccacacccagtggggtgggctatagcgcatgcaaatgtgggaatcgagcggaattctaattttatagccctaaaacaccaaataatgttgaacggtcatgacacgatgatgactaatgttccttaggttatttttgatgggctagcaaaatgttagaagattcgggtccggctgcccgggcccatgccagcacaagaaaatctgggaatcaggcaaattccatattatggcgattatggcgaggcgatgaataatattacttagattgttttttacaggctggcagaattttaggttatccaggtgcgggcgtctgggcctctgccggtggcgtgggctgtagtacacaaaaattagggaatcaggtagaattttagttttatggccctaaaataccaaaaaaggaggaaaagtcatggcgaggtgatgactaatgtgccttaggtaatattttatgttccgaaaaaaatttatgtgattcaggtccgggagctcgtgcccatgcagatggcgtgggctatagcacccgaaaatctcaaaatcatgtggaattccatttttatggccataaaatgctaaacataaggaacggtcatggagaggcgatggctaatgttcattgggtcgtatttgataggacggcaaaattataggcgattcaggtccggcgccgggcccatgcagatggcgtgggctaataatagcacacgaaaatctgagaatcgggtggaattcatgttttatggccctaaaacgcaaaaaacaaatgagaaacggtcatggcgaggcgatgacaaatgttccatgagtcatttttgatgggccagcaaaagtttaggcgattcggtttcgggggcccgggcccatgcagatggcctgggctattgcacacgaacaactaggaatctggtggaattccacttttacagcaataaaataccaaacaatgagaaacggttatggcgaggcgacgactagtgttccttaggtcggtttagatgtccggaaaaataataggcgatcgggtccaggcgtccgggcctgcgccaattgcgtgggccatagcatatgaaaatatgggaatcgggtgaaattcgagttttatggccctaaaatactaaaaaggaggacggtcatggcgaggcgatgattaatgttccttaggtcactttttatgggcagacataatttttggcgatctgtgtctgggagaccgaggccatgtaggtagcgtaagctatagcacacgacataattccaggtttatggacctaaaacatcaaaaatggaggaacggtcatggtgagccgattactaatattccttaggtcgttttggatgggccgaaaaaatttagggcgattcgggtgcggacgcccgagcacatacaaatggtgtgggctataccacacgaaaatctgattacctgacagaattccagttttatggccctaaaatgccaaaatcgaagaacggtcatggtgaggcgatgactaatgttcctaaggtcgttcttgatgggccgacaaaattttaggcgattcgggtgcggacgcccaagcacatgtagatggcgtgggctataccacacgtaaagcagggaatcgggcggaattcaagttttatggccctaaaacgccataaacgaagaacggttatggcgaggcgatgactaatgttccttaaatcatttttgatgggccgtcaaaattttaagcgattcgggtcagggcgccctggtccatgcagatggcgtagcacacgaaaatctaagaattgagcagaattctagttttatggccttaaaacgccaaggaacgaggaacggtcatgtgaaggctatgattaatgttccttaggtcgtttttaagggcaggcaaaactttaggctattcagttctggacgcccagacccatgtagatggcgtggctatagaacacgaaaatctaggaatcaggcggaattccagttttatggtcataaaatgctaaaaatgaggaactgtcatggagaggcgacaactaatattcgttgggtcatttttgatggtccagcaatattttagatgattcgggtttgggcgcccgggcccatgcagatggcatgtgctattgcatacacaaatctgtgaaccgggtggaattcaagttttatggccctaaaatacaaaaaaatagagaaacggtcatggcgatgcgatggatatgttccataaggcatttttgatgggatagcaaacttttaggtgattctggtccgggagctagggtctatgcagatggcgtgggctattgcacacgaaaatttaggtatcggtggaatttcagttttatggccataaaatgcataaaatgagaaacggttatagcgaggctatgaccagtgtgtccttaggtcgttttagatgggctggcaaaatgttaggcgatttgagtccgggtgcccgggcctgcgccaattgcgtgggtcatagcatacgaaaatataggaatcggacgaaattctagttttatggccctaaaatactaaaaaggaggaactgtcatgacgaggcgatgactaatgtttcttaggtcgtgtttgttaggccggcataattttaggcgatctgggtctggacgcccagggtcatgcaggtagcataggctgtagcacacgaaaattttgaaatcgggcgaaattctagttttatggccttaaaacgcgaaaaacaaaatgaatggtcatggagatgcgatgactaatgttccttaggtcgttcttgatgggacggcaaaatgttaggcgattcgggtgtgggcgcctgggcacatgcatatggcgtgggccatcatagcatatgaaaatatgggaatcgggcagaatttcagttttatggccctaaaacgccaaaaacgaaaaacggccatggcgaggtgatgactaatattccttaggtcatttctgataggccggcaaaattttagacgattcgggtaaggacgccctggcccatgcagatggcgtagcacacgaaaatctgggaatcgagaagaattccagttttatggccctaaaatgcgaaataacatggaacggtcatgtcaaggcgatgattaatttttcttaggttttttttgatgggcaggaaaaatattaggttatgcccatgcagatggcgtggctatagcacacgaaaatctgggaatcgggcggaattctagttttatggccctaaaacgccaaaatgtgaggaacggtcatgtcaaagcaatgattattattccttagttcatttttgattgtcggacaaaatgttaggcaattcgggtccgttcacccggatggatgcatatggtgtgggctagtacacgaaaatcttggaatcggacggaattccagttttatggctttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatccttttttactcattcagagaaacg

SEQ ID NO: 149 - DNA, 5000 bp, Artificial Sequence
  Description of Artificial Sequence: Synthetic polynucleotide
gctgatctacaaagggcttagaaagaagtaagaaaagaaatggataaaggaaagggaaagattgcagaatcctcagagctgttgaggaagaggagatggaactggtccatcaagaaaggggtacatcagtggaggttcctaccccaagccaaaaagcccaagacttcctccaagaagtcttcctctgtgtctgaggctgttgaacctacactagccaagaggacaagatctgcagtgaaaacaacaatcaaaaatttctgaagatgatgactggagtggagaagaagaagaaaatgattctgagaaggaacaggatagcttgccagtttggcaaaagaaagattttaaagggtagactgctgaaagacctggtggaaccaggaatgatgagatgtggatgctttagctgctcaggatggaaggacatggtccttcagatggatggtaggctagccagaaatgagctaattgaatttatggcaatgtctggttaaggatggcatgttagtagcctggtgaaaggagttcaagtgcagtttgatgcaaagaaactgggagagatcctggacataccctctgaagggtttgatgactatacaaggcaaaggtggccctgcctggactccctccctactgctcttgtaattaccaggaggttttgtgattctgaagatgtgaatgaagccagggctgtgcagaaaagtgaaatgaggcctgagcacaaggacttgtttgaatttgtcaacaagtgtttattgcccagacaggagagaagtcacattgccaattacatggatctagttcttatagagtgcctggagagaggaaagcaaatcaattgtctgccttcattatcaagctgctcgacagggttataaatggctccaaggctcatgctactctttatggctttattctaaccacagttctggatagtctcaatgtgcctctaaagaaatgggaaatgatctcgagaaaggatcactttggcatcaatactcttcttgcttgtgactatgcagtcaatgacatcccaaatgaacctggtacatcctagaagacacccatcaacagcaaagtcaggactctggttcaggaatatgtagccaaggatgctgaaatagctaggcttttggctcgtgtgattgaagtgaaatttgagagggatggtctcagaactgagcttgacaaagaaaaggagaaaaatgatggaattcttcataacatgctgaaccttctccaagcccaaacccaaccatatagttcttccaagccttaggactcctagcttttgtctcctgaacttgtttagtacctcagtgacccagattagggatttttctatcttttatttttgctcatgatttggatgtttttctttctttttgtggattgttggtggcaacatatctctgtcaatgataactactattttgctcttgtttaatgttaatttgtccttgatattttaaatatattttcttgattactgatgattactccatgattacatttgcagttgccgcagtggccatgggtacttattaaaatctgggaatcacactttgtatgtaacatttcgatgatgccaaaagggagaagagagttgtgctttacacacattctgaaataagtaatatttataacctaattaacctggtccttgatgttaagtgaattttctaagtttagtattgatggttaagctgagttcttacaggtcccaaataagtaaaaagcacagagtttgtcatcatcaaaaaggggaatttgttggcccaagaacaggtgaagttttgaagatgacaaaagaactcagacatggaccaggtccatcttgtgaagcacagtcatgatcaacctatacatgtgagatgcacgtgaaagagataagtcttactgattaagcaacaatatctcttgatctgatcgaaaaggatgaagatagtgttagagtttgagatcatcatgaactcttccacgatagaagagcagcaattgagtcacaatcaaactctgattactaacctattaaatgtcagtttgttctcttttacaggaaatacacatacgcaaaagttaaactaaattgagagcaaaagagcaaggcgattttgcaagcaatttatgtggatttgagtgtgcactcctgaagctacttgaacgagatagaagaaccagttccatcgtgtctatctttttctagttcaattgtagtaggtggtttaaattatacctttcagctttcatagaagcaattgtattagatacctagagtgttcaagttatagctaacttgaagttgtcgcaacagttgaggttgtgtgccacaacgggattagagttaatccttaggtttataaagagtttttgtaaaagctattttggctcagtgattttagtggaagtttgggaaaatcctactgagttgtaggtcatggttttttcaccttttgagccaggtgttttccacgtaaaaatctccgtgttctttatttctgtatttattattccgcaattagtagtagttggaacacctagaaaaccaagttcttctatagagtagttaagcgaaaattgggtgccacacaaacacccctctagtgtggtattgacgcttaaacatcaattagttaatttctggagcaactagctactagttgttattaaaatagttagtttctttgttagctaatatgttgttttggttgtaaattagttccggtgtgtagtttggactttggaagaagacttgtaccaattgtgtttgttattttctttggtcttatgaatgctcacactaaacatcaagttggtatttgattttgcatttgaattagaagtagtattgagacgtgttgttgctatgcataagtagtaaaagattggtttgagcttagttggtttcgtgataagattggaaataaaagaaatgtgtcaaagttatgtaaaaatcagtaaaataggctgctaccttttaatattaccacaagtccacatttattttagttttaaacaatataaatttgttaaggtaatcttcttacaatagtctcaacttttaatttagtaacagataattgcaaagtcaatccaactaatcatacactacccatatgtaaaaaaaaaaaaaaaaaaaaaaaaaaaaaaaagtgaacaatcaatgcacaaaaagaaaaaaaaatatttttcttctttaattaattccataacatagtccttaaaattagttaattcttgttttagaaaaattgtaacagtctagttaattctccaaaatgaagcaaaagattttttttcttaagtattacgtcactttttttattaatccaccaaataaattaaattagatttagttcactaaataaactcaataagatcagatgttttatttattttaaaaataactcaattacttaatcacaaatgatcatgactaactcaaaagtaatttgttttaacaaaaataattaatttcgtcttaaccgatgtcgggacgactcattttggaataaatacataaataaaatggccaggtcgcgaggacacgtcatattccaattctttcaaataagcttgttatttattaacttgagtaggctccaattttaggtgcggcgcacgaactaaggtcggagatattcatcttggttagcgtaagctagggttggggatattcgtcctagtttgagattaattaagtcatcaacagtaaaagtggacataggcaaaacatgaaaaccgaataaagcacaatttatccataattaattcatgccaaatttaagttaataaagcaactgtgctagaaccacggactcggagaatgctttacacttctccccgatcaacaaaaatctttattcggactttatttttgcagaccgataataatagagtcaaatcttcctttgactagggattcaaataaaaagtgacttggaacatgcaaaaatcaattccaagcgggcgaatctgtaaacaaaaaatccttattcaaatttgtcactttaattgaaaaactctttaacccactattcataacatatatatttttggggtagaaaaggggttgacagttatgacctactttatgcatcagtgttcgaatttattttgatcaacacccttttggaagagcgtttgatagaaatggttggcttaataaacaatcatattatcatcacctgcggaatcatatcattaacttttgaaaattaaaatggttttcaaagacgttttgataaaagaattcctattgtcgcagttggaatctacaagaccaagatgttgatctagtgctatatttggagaaagtgccttaattaaaaaaaattgttcattagttgtcttaagattttttattatttaaaaaaaaattaagacacaaagaaacacatttacgagtatatgtcggccgactaatgtgaagttcccacggacaacccacacatattgtggtcaagatggattctatcataatcaaaagtcatcatcaattcaattctcatatttggcatctcaagtacatgcacaaaagcaacttaggatgtaagtttatatgcacattcttgaaatagaacctatttatacgtagtacttaattagttacagtagtattatttattctctgctacagagctatggtttatcaaatatatcagattatcatttgttgtgtaggccatttccttatttgtacttggtattaattctggcaaaagcacaaaactgggaaatgaggttcttcttccttaatatgagtcacagattagtaccactactatagccaagaaaatgtgaaatcatatagtactaaatattaatttcagatgccaaaaccataaatttcccctcctccatcattgaaaacccctctgtcctttcccctagagagacccctttttcctctctctctccttctctttttattagacgcatatattctctcttctttctctttctagggttttcacctgaaatagttttatttcggtgat

SEQ ID NO: 150 - DNA, 5000 bp, Artificial Sequence
  Description of Artificial Sequence: Synthetic polynucleotide
atttaaaaccctaaaaaacaagatttttatctatctgcatggtgaaggacaaagaggtcttcaatctcaggttcttttttttttttttttttatatatatatcttgtttgggtttaaggttattgggctgatgaatgttttaattttaacataggtctacttacgtagtagttataggttgataatgagatataattaactaagtctttgtataatgcagatcctgaacttaatctttatttgtattatttttttttgttactgaaagattctgttaccaaattttatcagtctatttaattagaggccaacgattgttaggtatgtggcacttcgagtgggaaatgatatattcccattaaaggtgttaattaaccaccaaattgttctttaggtctgtttgtcattttgtattaaggtggatggtttattatatatatcttctctttaatgctaatcatgcttaactttttcatttagtaccagcaagcatatttgtttactttattggttattccttatcaaagtcttcatcttgttgcttttttttattgtactttacaaaagatttctagtattaatggaaagtgctcatatttggaaaaagacatggccaacaagaaatgtctatataccccatttcttcttcttcttctttttttccgaaaatttcttatttttgtttttatttctgtttcttgttgagtgctttcatggtagaagaagaagtaggagattcttggacatggctgcatgagaattgttaaataaccccgtatacatacacaagtagtgttggctgtctttgatatcaaaccatttattgccctaatttctgccttttgtcccctcaacaaaaccatcaaagttctcaaagagggtttattcttgtttcccactttgccccccacctattagggccaccccaccaaagggatctctctcgtgtctagtgttttttcccaaggaccaccactcctttttttttctctaccataacttcgtccacaccatcttattgtgatattttcgtttaatgaatttgcagccatgccttcattcatcatcagaactcagtcataagcacagattctgagagagtaattaatgaatgaatcagtggtgatttgacgtaaagtatacatgattatggtttttagctgaataagcagagggagaaaatatatacatatataaacaagtagagtaaaagaatgacgcaagattagtaccaaaagagtgaaggaagagatttaatattatagggaaaagggaagtagtaggtgatacttgacaggttgataagatggttattactacaagttgatgtattgacgctaactcacgcaagagagacctactcactgtacaatatttttacaagaataagcgattctttctctctttacttgcaagaattgtgtgttgtgtgagttgtatggcgcattttctaggagcctgtggtagtgatggatgtattcatataatacaatacaatacatatggaatagatagatagataagatggtgcacgcatgagaggcaattatgcaacttacgtcaactacttccatccatccatcttttcttccttctgtttctgtctgatatagtgagtatatgcttgtgctggtgttgtgtgcttttctggcctgggattttcctaacactttagataatttaggttcccatcaataataatgtctttttagaggagcatcatcgatagatattcaaatattaaacctggcctagctactatctagggcgtctgctaggtttttccattaccctttgtatatctcttatgtgggaccttttgtttatggaagaatatggagtacttttattcatctcgtagggtcttgaatacaagattttatatatatcactctttaaaaatgaccatcctaaaattcttcctctttcatttgcatttaccagaattgatattagtacctaaactagtactcttcactgaggccttttgtatttagtcctattatatttgaatttggcactatttaaattaaaaaaataatctacaataaaaaattcttccctaaacattacccatcaaatactcaccacctaaggtaactctaccatgtattaattttttggatcaaatctagtgaggattaattctccacttatgttctttcggaactggctaagtaatcttcaaaagctagggcatctccgcagtcatatcgtgccctcccaagtatagcgaccgcttctatattttccctgaatttcatctgtgctagggcttgttttcacgttgatttcaaacaaaggctaacaatttcattgagtaactttttctcatttcaggactcgaaccttaaacctctgttcaaataacttctaagaagtatatatgtatacaatgtttgtattcattgtgacaaagtattatgagttgtacaactttcttgtgaagatagagcataatgttaaacaaggatctatatagagcataatgtcaacaaaacaacaacatcaacccagtaatcatcctactaataggatttggggagggtagagtgtacgtaaaccttacccatacaggggagggggtaaagaggttattttcgggagaccctcggctcagagacaaaaaaatctataataacaacagaaaccagacaaataatatcagcatcataagagacaacaaataagtggaatgacaataattatgccaataataacattgaaaaaaataaaattaaaaattaaaaataaaaatagtgtgatgaacaaaaatcgctagcagtcttagacaaaacactatcagactagctggaacaacgaggaaaaacgctgaagtaccccctaacctacaaccctaatgctcgacatccacacctccctatccagggtcatgtcctcggaaatctcaaatcgcgtcatgtcctgcctgatcacctcgccccattacttcttaggtcgccctctacctcttctcatacctgtcaaagccaaccgtcacacctcctaactggggcatctaggcttctcggggccggccagcccgtagatctaaaaggatccatccatagcgcccgaaccatccacgcctcgctttccgcatcttgtcgtccatgggagccacgcccaccttatccagccttatccagcctagtgtgcccccacatcatctcaacatcctcatttcgactactttcatcttctggatacaagaattcttgactggccaacattcagctccatacaacatggtcgatctaaccaccactctataaaacttgcctttaaatttcagtggcatgttagtatgtttactttagatacaatgttttttagagtcttatagtcttgttagaatactatatattataaaatatggagacttctgggcacttttgttttattttatataagataggattggaatgaattcaattggagggacatgcatgataaatgaatattcatgtagccgatatatgtttgggactgaaacgacattattattgtgaaatattttacaattgcatttcacactcactgaagtgaaactttgattccacgtcggtcaatacttaggtgttacggtttggctgcgaggggaatcgaagagagcaaattaattaaagtatttaatgaggaatcatgagttagttggtggaattataatagtcaaatgaatgagttattcgcctgataatatagttgatagtagtatatactatatatgttgatactagttattggtggtgacctaattaagtaaagagaagagaagagtggttatgtaaaggaatctaggtatagtgggggatggggggaggcaaggttaaaagaaaggtggaaaatccaagaatcctgcttcctctagtaacatagcatatcctgcaattcgtgcttttgtttcctctcacaagataactacttttttgattaattattacatttgacacatacatacaaacctataaaattagacatccttatggaatcttacgactccgaacttgtcatatatcctttaattatgcttagctttttgctaaaaacaaaaaggatatccttattccaaaatgcaactaggagcatcttcccacatttcttttttatgcctctgcatcatcaaatcccataatgccgcacaacaatttctttttacttaagtatattctagcttagctatttcatacgaataatgggtatacaaatttgcttattttaggttttaaataccgatttaaatatattggatgggttcaacttttaaaattcttacactgatatacatgcatagaatatgtggaaaactttaatattaattacaactgctaaacatttgaatggattcttcatgccgtgtgctcctttgttgaagaacacgtactccctccgttcgcatttatttggcacgttttgacttttcacgccccttaagaaataataaataaaatgcataatttatcatgataaacatatcaatttatgcatattttattagatttgagaaaataatttgaaatgagtaataaatactgtgagtataacaggaaatttttttttgtcttctcttgatatgcataaaatagcaagtaaaaataaaaatctatttttaatataaatgtcaagtaaaagtgaatggaggaagtatttggaagggcgatatcgaataaaaaagttatactaataacaaacagcaacaattacaagaaactgtagagttggccagtaccaggtatatatgtagaattttttttatgaggaatttagtgaaacgctagctatttcaacacttcagacatatcaataccaattttatggtttctcttaggtgttgatagattctcttttgtcagcaaacattatttatgaaatttataataaaatgctgctcttttcgagtttacattctccgtcccaatacaatatatacttgatttgacgaaagaaatgtaacaatagaatcttaagtcggaaaaagtcaaatcaaatttgaaaaaaat

SEQ ID NO: 151 - DNA, 5000 bp, Artificial Sequence
  Description of Artificial Sequence: Synthetic polynucleotide
gaaaactaaaaaaagaactaaggcatttacactaggtcttcaccggggctcgtcccatcaccagaacccgttggcctcaggtctcttggcttctttaatcttggccgacaggtcaaaacctcgggaatggatatcctcgagggtctctctctggtatagccgctttacgtactcggtcttcatctttaagcgggcctcagctatctccacatcagccttatactgggccagcatttcctcgacgtcggaggaatcaatagaagttgcctccaacttggatctcagcgcgttatattcttggtcgagggcatcccattccgtgacggctgagttcagctgtgctcggagttcatcatttagccgagatcacttgtcggccttgtcctttgccacccggagttggtcctttatcgatgtcaactcctcttttgcagcctctttttccgaagccagtaggtccatcctgcccttctacgcctcggtcgtggccttgacctcatccatctcagcccgaagccggtcgatcaggtctaccttctcttggacctgggaagttgcgttgttagtcaccacgagtagcttctcatttttagcctcaaagatccttaccttctcgaccaagtcagcgtgctcccacttcatggacaaggcctccttctgagccttttccagctcggctcagagaattgggaggtacttgagggcctcgtcttattgttcgctgagagacctgtaaatgtccttctcccggatcagttctttaagctcgaactcaagctgactgatttgcaagagagaccgaaggaagctttcatgatgaagcattcaaatctgaaatataataaggtcattagaatatgcggagcaaatattcgcaaaggatacaaaggatagacgtcttacccggttcaatgcctattgcacctcgttgaagaggctctacgtgcctacttcattcatctttgcctaatccttatcggtcaccaggcaacgaaggtagctggctatgccgaccggagcggacagggctcgggcgtccatcgggatagtaagaatgaccattctcttacggtcggggtcaacacccggggggagggaacttcttcactagtttcgggctcaagctcgagctcggcttgctcgctcccgatgacacatccttttttgggacctccaggtgaccaagcctggagaagtcctccaatgcgaccatgtccatgccatcaaagaacgtgttgagggcattatctggacccgacgctatctcatttaatttctctttattagcttgaacctcttcgagcatggactcagtataggacggcgtctctgcgatgtcaatgatactagctacatccttcgggacaggagcggcttctcgataggccatggactccgtctctccctctggttctcgagctagagggggatcgacctcttggtcacctttcctggttgccaccttctccctctcgttgagggtcgactcatgagcaatgaactcaaggtcgtcatcctcaggataatccctaagccggtagagggaatcagatttcggtaccctcgacttggtgctctttttgtttttctggacctggacgaccaccctcttcttcttcacctcgacatccggggagcctgtggatttccttttattcttctttttctcttcccttacggcggcctcgggctgtcccgaagcggagggttcagcgagcgaggacggatcctcgtcctcatccaatggcttgagctcggtggtcatgggtgaacctgtgagaagaaagaagacttagcgatatattcatcaagtatatgaatgtaatcattcgggagagagactcactatgggaacgagcctcccatttgcccttcgagagcttgcgccatacgctcgaagtaggacatctatttgcacatcccctcgattcactccttgaagcaggggaatgtattaggaacctgggcaactgctacataatggcaaatacaggcaattagaaaaaagaataaaaggaaatgccagatactcgagagggaaaagacttacgggatgcgtttcactttttgaggaatggtagaaattcggagaggatgaggtcttcggttttcacccgaacgaacctcccctaccaacctcgatctcggtcctcgtcgatgctcgagaacggagccttgcttgctcggcgaacgatcttaatcaacccctctcggaagattcgaggactgtatagatgaagtagatgttcgagggtgaactgaggtgcttcagttttgtttacaaagtgttggaggaggattacgatcctccaaaaggacaggtgaaggcagaccttgcaccttttatagatgtcgaggactatggggtccaccgggacgagcgtgaaggagtaagtgtaaacacttaggtacccctccacgtgagtggtgatgtctttgttgggcccggggacgaccacctcctttccctcccagttacactctacccgaactatgggtagtgtctcctcagtaacagagcatatgtacctccatgctccctcgtctcggtcctgttgactggaggctttctcgacgttgaagtcattctcgatagagcagcccccgagtacgaagctcttcaagggaggctcatgggctacctcaggaatggccacctcggcatttatggccagattggaaaataaaggagcggtttgttgaggaacgaatttgaaagtttttgctatcgggttctgaaaaatatgaaggtttgaagaaaaaatatgaagatttgaagatagaatggaaatatgaaggtctgggttgaagattgaaagagaatgtatgaagattgaggatgaaggtatgaaaatctaaggagcaatctatgaagatttgaaggagttaaaggtatgtaaagaattcaagggtaaatcaaggagctctagaatcgaaaagtggagaagtgaaaaaggggtcggagcttttatagaggaaggacaatcaatgcatgacgtttcacattcgaggacagtcaatcaacggccgatacgtgtccgatgttagaacgatgcgactaatgggacgtttcattgatccgtcatctcggttgtaacgtacgaagaaaggaatcggggttcatttatcgcttcccgtcgtttcgataaatctatcctccgaaaaacaaggggactatctgtatacgggtaaaatcaggcaatgtctaccctgattctcctataagagaataaagggggagcgcggatccgcgagattgtaatcgaggacagagacccatcgtatcaagatccaagaagagtgaacgatatatctaacatcagacacggcaaagcgatgtaccccggaccgaatataactcctagacctcgggagaagcgggggacggttatgcatgacagataggagactgtatactcgccctcaatcggatattacgacgcgaatctcgtcagtaacaattatggatcaataattactggaaaaagaagatttttaccttttttagacttatactaggactgaaattctcgtactatataaaggtaaagtttttctttgatctgacacattgtaacacgcaattcaaagaaataaaaatttgtttttgccttctaactaatgttaaaaattttgctcacttgttctgttcttcattcacgactggactcgaaccgagggtccaatcgagtacgaggtcactgttcaatctaagatcatgcttggtcataacattgcgattggtttgatcatttatttcgtctttaattcatttatctgttatttttaattattcgtgttgaattaaatcacgtatcatttaaaccgcgtacaaatttaattgttacccatttttaaggtaaacaactatagacgaaaaaaaaaatataaatattaaatattatgtttcgaaagatacacaatagacaagaaaagaaaagaaaaatcccttataaaatttggatttagcccaccagttttattgagacgtctttgtgtgttagttacccggcaaaggttatgaacctactttatgcgtcaatgtccgaatttatttttatcaacatccttttggaagagcttttgatagaaatggttggcttaattagcaatcatattatcatcacctgcgctttggtgttatatcattcggaatcatatcattaccttttgaaatttaaaatggttttcaaagacgtttcgataaaaaaattcctattgtcgcagttggaatctacaagacgaagatgttgatctagtgctatatttggagaaagtgccttaattaaaaataaaaaattgttgatcagttgtcttaagattttttattattaaaaaaaaaaaattaagatacaaagaaacacatttacgagtatatgtcggccgactaattaatgtgaagttccacacggtcaacccacacatattgtggtcaagatagattctatcataatcaaaagtcattatcgactcaattttcatatttggcatcttaagtacatgcacaaaagctacttaggatgtaagtttataatcattcattcttgaaatagaacctatttaatagtacttaattagttacagtagtataatttattctctgctaaagagctattgttcatcaaatatatcagattatcctttgtggtgtagaccatttccttatttgtacttagtattaattctggcaaaagcacaaaactgggaaatgaggttcttcttcattaatgttgagtcaagattagtactactactatagccaagaaaatgtgaaatcatatagtactaactttcccttctccctagctactgataactctaattaatttcagatgccaaaaccataaatttcccctcctccatcattgaaaacccctttgtcctttccccccagacccccttttcctctctctctctctcctttctctttttattagacgcatattctctcttctttctctttctagggttttcacctgaaatagttttatttcgttgat

SEQ ID NO: 152 - DNA, 5000 bp, Artificial Sequence
  Description of Artificial Sequence: Synthetic polynucleotide
attataagggaaattaaaaccctaaaaacaagattttatctatctgcatggtgaaggacaaagaggtcttcaatctcaggttctttttgtttttttaacttgtttggatatgaggttattgagctgatgaatgttttaattttaacataggcctacttacgtagtagttataggttgataatgatatatatttaactaagtctttgtataatgcagatcctgaacttaatttttatttttattattttgttgttaatgaaagattctgttaccaaattttatcagtctatttaattagaggccaaagattgttaggtatgtggcacttggagtgggaaatgatatattcccattaaaggtgttaattaaccaccaaattgttctttaggtctgtttgtcattttgtattaaggtggatggttcattatcttctctttaatgctaatcatgcttcaccttttcatttagtactagcaagcatatttgtttactttattggttattccttatcaaagtctttatcttgttgcttttttttttattgtactttacaaaagatttctggtattaatggaaagtgctcatatttggaaaaagacatggccaacaagaaaggtgtataccccatttctttttctttttctccaaattttttttttttttttttctgtttcttgttgagttctttcatggaagaagaagaagagtaggagattcttggacatggctgcatgagaattgttattgttttgtgcacttaaataaccccgtatacatacacaagtagtgttggctgtctttgatattgcaccatttattgccctaatttctgccttttgtcccctcaacaaaaccatcaaagttctcaaatagggtttattcttgtttcccactttgccccccacccattagggccaccccaccaaagggatctctctcgtgtctagtgttttttcccaaggaccaccactacttttttttttttctctaccataacttccacaccatcttgtgatctttcgtttaataatgattttgcagccatgccttcgttcatcagaactcggtcataagcacagattctgagagagtaattaatgaatgaatcagtggtgatttgacttatacatgattatggtttttagctcaataagcagagggagaaaatatatataaacaagtaaatctagtagaagaagtagaagttttatagctagagtagtgggaaagaatgacgcaagattagtaccaaaagagtgaaggaagagctttaatatagggaaaagggaagtagtaggtgatacttgacaggttgataagatggttactactacaagttgatgtattgacgctaactcacgcaagagacctactcactgtgcaatatttacaagaagcgattctttctctctttacttgcaagagttgtgtgttccgagttgtatggcgcatatgaaccttttttcatacaatacaatacatatggaatagatagataagacggtgcacgcatgaggcaattatgcaacttaacatcaactacttccatcatcttttcttccctctgtttctgtttctgtttctgtttctgtctgatatactatatgcttctctggcctggattttcctaactcttttgataatttaggttcccatcaataatgtctttttagaggagcatcatatcgatagatattcaaatattaaacctggcctagggctagggcgtctgctaggtttttgcattactctttgtatatctcatctgtgggaccttttgtttatggaagaatatacttttattcatcttgttgggtcttaaattcaagatttaatattactctttaaaaattaatgactatcctaaaattcttcctcttttatttgcatttacaagaattgatattagtacctaaaactcttctctggggccttttgtatttagtccttttatgtttgaaattgacactatttaaataaaacataatctacaataagatgttcttcacccttcgggttgcccggttggtttggatgggatcgattcccccgatatcttctgggttgagcatatcgcacagggcttgtctagtgcggtttgcattccctatgtggtttgcattccctatgtggtttgcatgctattatacatgggtttacccagtggacacaaagtattcaatacagagtgttcacccgaagaacagaggctgtggcaaagattgtaacggccgcgggtttcccctcttacaaaaaaaaaaatgttcttccttaaacattacccatcaaagactcaccaaagatagctctaccaagtattatttttggatcaaatggcatttccacggtcatatctcctcccccccccctcacccccccccccaaagctagtgatcacttccatattttttcctgatttcatcggtgctcaaatacttgttcattcatcttcattccaaacaaaggcgaaaaacttcactattgagtgcttttttcctattccaagtgtcaaaccctaaacttctagtcaaataatatctaagatgtatactcttatactatgtttgtattcattatgacaaagtatgatgagttgtacaattttcttgcggacttagtgaaaatagagcataatgttaaaaaaatatttacatgatattaattagccggattaagtttataacgttagtatatatgtctactttaggtacaatacaagtcttatactcttgtcagaatttatatgtcacaaaatatagaaacttctagctacttttttttaattttatataatataatattggaatgaatttaagtggagcaaaagtgaatattcatgtagtcgatatattctaatctgtttggggctgagatgacatgattgtagtgaaatattgtaccattgcatttcacactcactgaactgaaactttggttccacgtcggtgatcatttgcatgtttcattagtcaatactgtggctgttatgatttggctgcgagggggatcgaagagagcacattaaagtatttaatcaggatttatgagttgaatgctgttagttggcggaattaatagtcaaataatgaatgagttactcgctgatatagttaatagtactccgtatatatgttgattctagttattggtggtgacctaagtaaagagaatagatgagaggagtggtggtatgtaaaggaatctaggtaaaggggtgggggtggggggaggcaaagttgaaaagaaaggtggaaaatccaagaatcctgcttcctctagtaacatagcatatcctgctattcgtgcttttgtttcctctcacaagataactactttttgattaattattacatttgacgcatacaaacctataaaattaaactaatcaacgacatccttatggaatcttacgagtccgaacttgtcatatatataactttaaagtactttgtcacttcttaatatgctcctttaattgtgcttagctttttgctaaaaaacaaaaaggatatccttattccaaaatgcaactgggagcatcttctcacttttcttttttatgcctctgcatcatcaaatcccacaatgccgcacaacaaactcttgttacttaagtatatattctacttcataagaataatgggtataaaaatttgcttattttatgttttaaataccaccgaaaattcataagcaaattcaggatttaaatatattaaatgaattcaacttttaaaattgttgcacttatatatatatatatatatatatatgcatatccaagttgagggatacgggttcacatgaactcatattactttctctaaaccatgtataacaatgttatattttttcaaaattatttaaatatatgtgtgtgaacccattctcaaaatctcttatggtgcaattattattgggtgcacatctacaagtgaaatttgcagctcaaaacctcatctgggcggtcttgttttccgcatggagtataactatatatgtgaaaattactagaatttcaaaatgaatataattttgaaatgttgtgggttcctggtaagagactaaagttaaactcgtcaaatataaattctagatccacctcttcacaatagtgcacccattcttttgaaattctggatctgcctctgttaataatatatatatatatatatatatatatatatatatatatatatatatatatatataaacacaaaaaaatatgtggaaaactttactattaattaccactgctaaacatttgaatggattcttcatgccgtgtgctcctttgttgaagaacacgtacttgggagggcgagatttcgaataaaaaagttatactaataacaaacagcaacaattataagaaaatgaaaataaaagggaaagagcactcacataaactagaaactgtagagttggcaagtaccaggtatatatgtccttgaatgttttttacgaggaattgagtaaaacgctagctatttcaacacatatataaaaagcatcaataccaattttatggtttctcttaggtgttgatagattctcttttgtcagcaaagttcttgcattaactatatgaaatttataataaaaatgctgctcttttaattgagtatacatgcagtctcctaacatatacattctccgtcccgatatatacttgatttgatgcatttcaaaaattaaatgtttgagtgttttggtgaattgtgcttgatatagaagtatttaaaataagaaagaaatgtaacggcagaatcttaagtcgaaagtcaaattaaatttgaaaaataaaaaataatactcttgatacttactagtactagtcaatgggcagctctttcgggactaaccaaaagcattattcttattgtttccggcatagtattaaaatgtaacaatgcttaattatgttacaaaattaatgtttttgtggacttcggaataatttatttctgaattcgccggtgttatcgaaaacatgggga

SEQ ID NO: 153 - DNA, 5007 bp, Artificial Sequence
  Description of Artificial Sequence: Synthetic polynucleotide
tgggggccctccgcacaagggaggagctaggggaggcaagaaaattacatgtgtatataagattaaattttcttcttcttttttgtgtataggataaatatttaattttcttaatttttttgcgtagttactcttttaattatttttaactcctctgaacgcaagtcttacctccgccgctgactcctctagagaggaggggtctaaatgcatgcaactcaaacgacgaaagggtctttgcctaactaaaggttccttattctaatatatccttctagaaaaggtaatagaagttgattcgaatatcaaagagagatacatgtcggttacaaaaataattctcaagataatcaatagacatctctagattctcggacttaaaagatccatttagacacataatcatattttttttccaaacaatcgtcgaaggcagcttgttgcacaaaatatttcgtatttacataaggtttaaggaaaaatcgtacttcaaagagtatgatgtagataatacattctaattagggtcggctctataggtgtaaggcaagtgtcttaggccccaattttgggaggccccattttttagtaatactatatattttagaggtttataatttttttttaaataattaaataatatatatagtatttttttacttttcatatataaaaaagaaaaacttttaatatattaataaagtaaagattaaaatagtactaaaaaatagttgtcactttgatttgatttgacaactttactttttgctcttcttcccaaataattcctagacccaatccaacatttcaattttcatatagaaggatgagacatagtaacataccttcttcctttcttttgattcgtgctcattttgtttctactagatttctttctttctccaaaactccaacaagccaacaactacatattttgaaatcaaagtcttcaaattttttgaatcagttagtcgggtaatatcattctaactttttagtattatttttatttattatttattattttattaattttaccatgtacatattgtttaatttttttagaatataaatatgtctacaagaaaatatgcatccggatattcaaaaatccaaaagaaaagaaaagttgaaaatttaataaaatctcaaaaaggagttctcgagaatttttgacaaataataaaaaaactaaatcgcaaaatgtaggagaatattctgtagatgaacaagtcactaactttgagtcagatgataacaaaattcaaattgaagaagatgtttatgagaaatctgacgaagaaacaaactttagccttaggccctatattaaactttggccctaggcctcatatgagcttgagtcgcccctaattctaatacaagtattagtggctactttcacggcttgtgacttatggattacaaacaactttacagttacgtcaaggctccacgtagttctcaatttatggagcatatattagatgattaacgcagggaaagattctgctctcctctgatacatggctattattcctcgtttagttcaaaaaggaaaaagagggtagtcttgttatattattggggaatgaattatggtttcaaacttttcaaacttaaaggattttgtacatggtaaaacctaaattgacacgtaacttggtactttcaaagacacgatcttttacgcgatattttaaataaagaaaagatcaagtcaaaacatgggccaaaaagaaaaaccccatgattttttctgataaaaagctgctaacttttagtttgttttatccaataaaacatctttaacggtctgcctgctttagtttaatcctctttttaagatgtaattaagcataaaatagaaaagggaaaaaaaaggtccattggattttggaagaaattttaagaaagtacaagaactagtaaagtcattttgtatagagtatgttaaaaaggtgagtgacaattcgaaaaagaaagcattgataagtcaatcactaaataaaaaagcacacctaataatcattcattcaaaaaaacaaatttctatgaaagataatcattatcataagtcactgcagaaatcccatatacagtagagtaccaggattttacgataaggtgttagcaaactatctattcattttttgacaagcattttatgtttggtcatttgttgggaaaaattagggagaaatttaaaaatagttagatttacaactggtcattaaaaatagcccaatttcaaaagtaatcgaaatttagccacttttcatgtaaagataaatctgagcgaaaatattgttcaaaacccggaaaatacgcccgtatattatactggagttccagcataagtatgcttgaactccagcatattatacgggagttctaggataactatgttggaactccagcataatatgttggagttccagcataagtacactagaactccagcatattatacgggagttccaacaagtataactgtcccgtataatatattggagtttggagcaccggtgctccagtctcccgtatattatacaggagtcagcaaagtataccggtccagcataatatgctggagttcgtacacagatgcaccgaactcacgtatattatgcggaaccggtctctgttgcagcaaaatagtggctatttttcattgacttcgtaaacggtggctatttttgaatgaccagtccgaaaactggctataccgtgctattttgacgaaaaattatccccccacccacccacccacccaaacgcaccttacacacattagtgcacatcttttaactagtttttggttatttttttatttgatgcccgatattcgtatatggatttcgattaattagaattcacaccgaaacattctttcttaggattttgtacatacttaatatgcgaatacaaaacctatgcggaaaggtaagggaacctattcatccctctacagtacttgtgataatgttatacttttttgaatttaatttgggagacatgtcaatctttattttgaaaaaaaaatagaataaaaccatagggaaatgaacaatttatctttcactcctatctcattttatttgtcttgaatttttcaaaattttgaattatattttgaaacttcttcaatttattttcttggaatcttcagaattcaatttaaaattccaaaattccaaggatttagctcccgtttggccacagattttggcttcatttttttaaaaaaaattttgaaaacattctttgtttatgcaatatgatcatgttttaggggaaaaaaattaaaaaaaataaaaaaaaatcaaattcccaaaaactggttaggcaatttttggatgatattttttcttccactcacaaaactttaacatgtccaaacacaacttcaacttcaaaaattattttcaacacaattttaaaaactcttttttcaagtttcaatcaaatctatatccaaatgttagcttagtatcaaataagtgattgaaatcaaattaaaatcgagtggtaaataaaatagaggagagctcggtaaattacaagagtgcggtaaatcttttctcctttactctcactgtagcctattctatctgttgtaactaataagtaactgagctacggaaaaagtgcctagacttttaacttcacaagtataataaatagaagtcaattctttcataatattgtttccatcctatcaaacagactttgtctcactgaccttccttctgagtgtgtcttttatatgtcatttttagtgaatccatatgatttagagactctaatattccacatgcgggtcttaatttggtgtatatgtatatggtaataatttttgttaggtagctgtagtattctattattgttatgtattgactcatcatgtaaataaagccggttagataaggctagaaaaatatgagtatacctagaaattattagcatattgtttggaacatgtcaaaaatttcaatgacctagctagagctgtcaattagtcaaataactttattaatatttacttatgaaaacactttgaaattcttggagtttaagggaaagactactgactaaaaaacaaagcaaaagtctatgcattactatactatacacagcacagcattttccaatagtatttgagatgaatctccaatcagctactgttgttcttttcttttctttatttagtttaagttttatgtgttgatggtatacaaattatttgcacaatcaaatggcttatctggataatataggtaaacctcttgtaatcactaattggtaatctggtaaaaataacactatttctattccaatttatgtgatcaatttcactagacaaaaatttaagaaagaaataaattttttagaacttgtagtcataaacaagttgtaacatttgtatggctataatttttttaacttgtgatgttaaacatgtcagattgtttgtgtagctataaaagtttttcattaggcgtaaaattaaaaatttagattaaattattattaaatttagaaagaggtcattttttttagcgaagtaaaaaagaaatcggttcacataaaccgaaacatagagtaagtaatctgttatgacaaattaaaaattacttgtagtgtaaaaaaatctttacaacattcgtgtatatacttaaatcttttttattttttggcaagagatagttgttcagcaaaagtaagttagaaataggtctgtccttctgactttgtaactctgaaatgaaaatttcaaaatcccttctatttttcttttccccccccccccccctcacaaaccccaactcactcttatttaataaaaagctctacttagaaaagacacccttgtccatctgtctatataggtagaatgagagtaaaggagaaaacatatcctcctctccatttctgtagacaaagattctcaaagagaaacaaattaaacactagagagtgagagagtgctataagaaaaagaat

SEQ ID NO: 154 - DNA, 5000 bp, Artificial Sequence
  Description of Artificial Sequence: Synthetic polynucleotide
agaagaaatgactgttgaaaagaaaacaaatgcaagtaccattaggaagatttgaaagggcgtttgggtatgggggttgccaagaagattcagactttttttggggttttgtgtagttgtggtagaattattattgaatgaaaaaaaaaaacttcctgtactttaattcgtcagtacatactacatactactacaaagtagttaaaagcctattctatttgtgctttttttttcactcgatgttcaataattatattggtttttgattaaatttgaatttgagcaaggaagatcaacattggagggataaattgtttcctaacgaaggcgattacatacttagaacttgaactcaatatctctaattaaaaatgaagtaatacttataataactccaccacaattcttattgttgtgcatttctttataaaatatgtaaataatgggtcatatatattgtttaccttttctattcatatacatagattttaaattaattatacacatatatataatacattaattattcatatattatatttttgctagctatttttagtttaagcgatttggtaggcgactacttgggttaattctttttttttaatatatatatcaaaataatgaagctgtataatacacttaaaaatcatatttgaaaggtattaaatacgacttaggagagttcttaaaccattttggaaccttgtctacgtacttttatgcaatagctgtttttgtttgtctctgctaaaacctatgctccccaaccgtgcaccaatcaacttagaagttagaactcagaaataaatgtaactatactccacagaaagttaaaaagttttactgttaccattcactcaaggatcagaaactgaaagacaaatgaatcagtgcttcactgttcttcactaaaagaaatactgtttacattagtttcaaaagagtttaatcataaaaacaaatgtaccataaaaaggggagattatcaacctgaaaatgaaacagaacatacgttatatatcaatctatatacggtcgagatcggactcgtctattacacgacagatcgggattgaaacgtaacagttttgaagatcaaccccgggttccgtcggaccgaggtacaaggtcagaatgcccgttctcgagaacatcgagtccatgaccccagaatcaaccctgaccccaaatgagctcgaggaaacatccggataacggaaggcgaaatatccgtaaccggtcgggtatcacggcatgaatttcggcacgtaacaatgagaaaccggctaattagcaaatcatggaattttttaccttttatagaattgtaactaaagtgggattcccctactatgtaaagggggtctgactatttgtacgggacattcattaaacgcatcccaaagtaatataatattattttctttttgtaagctattgttctcctgtatctgatactatttgaattgcatcaagttcaagtgagactcattttttcaaggctataattgttcaagtcgcacggtttgaatttattcgatcattgttcgctttaattacaattcaattcatcgctttatgtcaaattaatccacatatccttaaaaccacttacaaatttaattgttatcaaattttaagggtaaacagtttggcgctcaccgtggagctaaggataatagtggttgtttgatatagattttcataacacacactattttacaattgttcttcgaagtgtctctcatttcaggtttaagctcaaaatgtcaaactcacaattggcacccctacctgcacacaatgagtctggtcaccatggtgaaaataacaacatagcacctggtaacgaggtaccgcccgctgatcccatcagaatttcaatcgcggacccgttggacgctaactcgcatgtggctatcgacatgttacagtctcaacaggcgacgatagctcagttacaaaaccaaagccgcacaccgagcagagttgaactcgatccgtcccggaaaatcacctgcagggaagaaccgtccgcggagaggtcaaatggagatgagtcggggactaaccccgagatcataaaaatgcttgaggaaccgatgatacggattgaatcaggggaaaagaaaatcgaggcaaatgacaagaaggtaaaaacttacaatttcacggtcaaccaaatcccgggagcaccgccggtactgaaaagcttggattccaagaagttcgtgcaaaaacatttccctccgagtgtggccccgaaatcgatcccaaaaacatttatatgcccgagattcttaagtataatgggacaaccgacccaaacgagtatgtcacttcttacacatgccctatcaaagggaacaacttagaggttgatgagatcgagtctgttttgttgaagaaattcggagagaccctgtcaaatggagctatgatatggtatcacttacctcctaattctattgactcatttgcaatgcttgcaaactctttcgtgaaagcacacgccagggctatcaaggtcgagacccagaagtcggacctcttcaaagtaagacagaaggataatgagatgctcaaagagtccgtgtcctagtttcaaatgaaacagaaggacctaccaccggtcgctgatgattgggccgttcaagctttcacccaaggactcaatgttcgaagctcggtggcttcacagcagttgaagcaaaatctgataaagtacccaactgttatttgggccaatgtgcataaccgctatcaatcaaaaatcaaagtcgaagatgatcaacttgaggctctttccgggtcggtttaccctgtcagactcgtcgacagaatcaagagagatatcgaccgtgaaccaaggtcaaacgtagatcattactagccatatgatggagattggaaaagcaataggtctgggtgaagttctacacagaatgaaaagagaaatgatccaggtcagagcactcgaggactcgcaagcaagaacgacttcgacaggcctatcaggcctaaagaagcaccaaggttatcgaaatataactttaatattgatgcggctgccatcgtatcagctatcagacgcatcaaagataccaaatggcctcgacctttacaatccgatccagcccaaagggatcctaaccaaatgtgcaaatatcatggcacttctggccacagaataaaggattgtcgacggttaagagaggaagtagcccggttgttcaataacgggcaccttcaagaatttctgagcgaccgagccaagaatcattttagaaatagggattctaacaaatagaccgaaccagaagaacctcaacacgtcattaacatgatcatcggtggagtcgatgcccctcaagtgctgatgttgaagcgcaccaaagtgtccattacaagggaaaaacggactcgagattacatattagaaggaaccttgtctttcaacgacgaggatgcagaagggatcgtgcagcctcacaatgatgcattggtaatatctgtactcataaataaatctcgagttaagcgtgtgttaattgatccaggtagctcaaccaacatcatccgattgagggtcctagaatggcttggcctacaagatcaaatcatgcctgcagtccgagttctaaatggattcaacatagcatgcaaaaccactaagggagaaataacattgccggtgaataccaccagaaccatccaggaaaccaagttttatgtgatcgaaggagacatgaggtacaacgctctgttcgggaggctaaggatctacagcatgagggcagcaccctcgactcttcaccaagtgttaaagttcccaacgtcgggagggatcaaaacaatctacggggagcaaccggccgcaaaagaaatatttgcagtcgaagaagagatcccggtatagacactagcaacatcaaaggaaccgagttcggataagaaataataggctaaatagcaattatcgacaccagccacgacccaatcggataaaaaggggactgatgaagatgatgattatggggttcccagatcttttatagtccctgatgattctgacgccaccaaatcaatggtcgaggagctggaacaggtcacattaatcgaacgtctacccaatcagaaggtatacctgggcacgaggttaacccccgagcttaggaaaaactcattcaatttcttatagctaacatagactattttgcttggtcccatattgatatgacagggatcccaccggagataatcattcaaaagctgagcctggacttgaaattctacccagtcaagcagaaaaggagaccccagtcaaaaatcaaacatgctttcatcaaggacgagtatttgcacaaaactttcaacatattgaagaagtacaatatgaagctaaacccggagaaatgtgcattcagagtcggatcaggtaaattcctcggattcatggtatccaatcggggaattgagatcaaccccgacaagatcaaatccatcaaagatatcacgatcgtggacaacgtgaaggccgtgcaaagattaatcggccgcatagccgccttggggcaatttatctcgagattctcagataaaagtcaccggttcatttcgctactaaagaagaagcacaacttttcgtggaccccggagtgtcaccgggacttggaggaactcaagcggagatagctgcttcacacaacaaaggcaaacgaacaactatacctatacttggcagtatcggagatagcggtaagtggagtcttggtccgggaagaacaaggtacacaatttccaatttactatgttagcaggaccctaggtgaggccgaaactaggtaccctcacctagaaatattggcattcactttgctaagcgcgtctaggaaactgaaaccatatttctagtgacatcccatatgtgttgtgattaccaaccaattgtggaatataatgtataaacggctactctcgggatgattggccaaatg

SEQ ID NO: 155 - DNA, 5002 bp, Artificial Sequence
  Description of Artificial Sequence: Synthetic polynucleotide
aatgcagcctcagtcttcaacataaaaaatcacatgagtatataagattaatttttttttttttgtatatatgttagatgttgaatttcttagttgttttgcgtgtgttttttttttttttttttgacctccctcggtaaaagtcttacctccggcaactgtctccgcgagagagagggggtctaaacgcatgtaattattcaatgattgaaggatggtctttgcctaaatactaaaggttccttattgtataggtcataggtgttgattcgaatatcaaagagagattcctgtgggttataaaagtaattctaagataataaatactctttttagaggtgttgttttactgtaaaatacgtatttggttaaagtgatagacatatctagattctcagacataaaagatccatttagacacataatcatatttttgccagatagttgttgcagctgaaaattggagcatatatacttagaagtagcataacactttacttccatatagtcggatggaaaattggagtatcatatcttcttttaattcacagttaaatctttaaacatatttaataaattttttaatacaaatataaagtctatgcaaaagttattgggttggtccaagcccttaatttcgatctctagctccgtccccgcatataattctaaaacttctgcttctcctatgatacatggctaatgtttatcgtttagttcaacaagaaaaagagggtagtcttattatattatgaacggcaaaggtccaaatatgcccttgtactatacgaaattgagtacatttgccatttgttaatactttagctcaaatatacccttaccgtcacgtagttggtccatatacactactagaaatccggtaaaaccgaccaaaaaaaccgaccaactttggtcggtaatggccaataaccgtccaaaacacgaccattacgtgtggacggtattttaggggtcggaaaggcataccgaccaaagttggtgtaaattaccgaccaattttggtcggtcaattaaattaaaaaaaaaccgaccaaagttgatcggtattttaattatgtaatcaaaagattgaccatctgggaatcgaaccggggtttgtattgtggcaggatactattctaccactaggccattagtgcattttgttttaagactgttttttatttgatttatactctttaattgtattttcgcacgaaaataaccgatcaaagttagtcgattttattaaaaaataaaattaccgaccaaagttggtcggttttttaaaatgaccggccgaattaaccgaccaattttggtcggttttttaatattaatttttatttattttaattaaaactgaccaaaattggtcggtttcttgaaaaaaatttccgggactcgaaaatagtttttcgcatttttctccaaagaaaaccgaccaaagttggtcgatttcgtaaaaaaaaattaaaaataaaatattttaaaaaaccgaccaacttttgtcggttttttggtcggtgttttgaccgaccaaagttggtcggtcgaccttggtcggtttttgccgaatttctagtagtgatatacccttagagttacacaattggcacatatatgcccttctcaaaacgaaattcacccaaaaattatggtttaaactttaaaataataaaaacatctcaaactttaacaatactcaaaagaccaaaatatttaaattatttctaaaaagataatttaatgattaaaagcctagagttcaagttgtagtgttataaatttgagttgttagtctttttcatctttttcagctggacattttctattttttttattaactatgtaaattaggggtgtacatggaacgggttggatcgatttttatcaaaactaaaccaaaccgattatatcggtttgaattgttcggttttattggttttttcagattttttgttacataaatattatttcaatcttgctttgttaaattttttagaactaaatatatgttcagtaaaacttaaaaaattgacaaacatatgatctatcttgattaccttatgggagaattttcttagtaattggaattcatgagttttgtcaagtgaaattggtgacgaaaatagagaagacatcagtaattgaggaaatcggataagggagaaagaaaaagaaaaaaagaaaaaaagaagaaagaaaagagaaaggtaaagaaaaaagcactaataaaaaggaaatagtatttgtaatatactttaatacaattaacgtaagagctaattagtttgagtggattccgttttgaaaagggcatacatgtgccaattatataactctaagggcatatatggaccaactatctgacggtaagggcatatttgagttaatatattaacgaatgacaaatgtgctcaatttcgtataatacaaggacatattacattttccctattatgaaatggttcaaacttaaggattttgtacatggtaaaacctaaattgacatgtaacttggtactttccattgggcaaagacacgatcttttacgtgatattttaaatcaagtaaagatcaagtcgggccaaaaagaaaaaaacccatgattttttaagataaaaagctgctaacttttagtttgtttcatccaataaaacatctttaacgatctgtctgctttagtttaatcctctttttaagatgtaactaagcatgaaatagaaaaggggaaaaaaaaggaccattggattttggaagaagttttaagaaagtacaagaactagtaaagtcattttgtatagagtatgttaaaaaggtgagtgacaattcgaaaaagagagagcattgataagtcaatcaataaaataaaagcacacctgataatcattcattcagaaaacaaatttctatgaatgataatcattatcataagtcactgcagaaatcccatatacagtagagtaccaggattttacgataaggtgttagcagactatctattcattttttgacaaccattttacgtttggtcattttttgggaaacgaactctcccaacattcttccaaattaccccacgcaccttactgtgcacatcttttaaccaacttctggttattttttcttttgatgtccgatattcgtatatgaattcccattaattctaagttgcaccgaaatggtttttatcaagattttgtatatatttaatattcgaattcaaaactaatggtcgaaggtggaagatcgtatccatcccatcataatatttggttggtaatatcacacctttttgaatttgggagacttgtcaatttttattttgaaaaaagaaaaaaaaaagaaatagaaactaaaaccatagggaaatgaacaattttattttcactcctacctcattttatttgtcttgaatttttcaattttgttttgaaacttcttcagtttattttcttggaatcttcagaatttaatttgaaattccaaaattccaaggatttagtgtcaaatcagtgcttgaaattaaatttaaaacgagtggtaaataaaatagaggagaactcggtaaattacaggagtgcggtaaatcttttctccttttctctctttggagcctactctattctattgtaactaagtaacttaactacgaaaaacgtgcctagacttttaacttcacaagtataataaatagaagtcaaattctttcataatattgtttccatcctatcaaacagactttgcctcactgactctccttctgagtgtgtcttttttatgtcatttttagtgaatccaattgatttagagactcaaatattccacatgcgtgtcttaatttggtgtatatatggtaataatttttgttaggtagctgtagtattctattattgttatgtattaactcatgtaaataaaagccggttagataagactagaaaaaatagagtctacttagaaattattagcctattgtttggaacatgtcaaaaattcagtgactcagctagagctgtcaattagtcaaataactttattaatattaacttatgaaaacacttggggattcttgtagtttaagggaaagactactgactgaaaaacaaagcaaaagtctatgcattactatattatacacaatacagcattttccaatagtattttagataaatctccaatcagctactgttgttcttttcttttcttttttagtttaagttgtatgtgttgacggtatacaaattatttgcacaattagatggcttatctagataatacgtgtaaatctattgataatcattaattagtaatctggtaaaaataatattgcttttgttctaatataatgtgatatatttgactgggtacgaaatttaaaaaaaaataagacatatagaacttgttgtcttaaacaattcataacatttgtgtggctataattcttttgaaacttatggtgttaaacatgtctaattgtttgtgtatgtataaaagattctcattaagcgtaggaaaatttgaattaaattatttttttaatttaaaaagagatcactccttttagagctgacttaaaaagaaattgattcacataaactcgcacggagggaataagtaatatactatcaaaaattaaaaatcacttgtagtgtaaaaaaatctttacaccaatcgtgtatattctcaattttttttttttttttggcgagaggtagttgttcagcaaaagtaagttagaaataggtctgtacttttgactttgtaactctgaaatgaaaaattcaaaatctcttcttttttactgttttaaaaactccaactcactcttattaatataaagctctagttagcaaagacacccttgtccacttgtctatatagcaagaaagagagtaaaggagaaaacatattctcctctccatttctgtagacaagattctcaaaaagaaacaaattaaacactagagagtgagagagaactataagaaaaagaat

SEQ ID NO: 156 - DNA, 5000 bp, Artificial Sequence
  Description of Artificial Sequence: Synthetic polynucleotide
agaagaaatgactagctgttgaaaagagaaaacaaatgtaagtacaccattaggaagatttgaaagggcgtttgggtatgggggttggcaagaagattcaaactttttctggggttttgtgtaattgtggtggaattattattattgaaacttctttacttcaatttaaatcgtcggtacatattacgtagttgtagtaaaagccttttcctttttgtgcttttttttttttttcgtgttcgtattaagacttcattaaatccaaatttgcatagggacggtcaacattagaggaataaattgcttcctaacaaagacgattttatactcaagagttcgagcccgaaaaacgacctctggttaagggtaaaaatagtaattacaataactccaccacaatccttattggtgtgcatttcttcattaaatactccctccaatccactttaattgatttgtttttggctatttttatatatattaaggaattatcttttagcattaatcaataatgaaattgaccatattaaccttttagttcattggaaatataacaaatactcctaggctttttaattcaagagcaacttttaaatccgaatttgggctaagaatacaagcttgttcttttttatctgtttttcactcggtgtacgaggactcaattaaatccgaatttgagctaagaatacagacattagaggtaatatgctttctaacaaatgtgactcaatgttcagactcagaactcgatatctctggtaaggatgacatagtacttacaataactccatcataatctttataggtatgtatttctttataaaatatgtaaatagtgttatgattttttgtatcaaaaatgatgaagtataatactcttaaaaatcatactccatccgtttcaatttatgtgaacgtattttctttttagtctgtgccaaaaagaatgacctatttccttatttggaaataatttacctttatgcaatgatttatagtcacacaaaatatatgtgtctcatttttaaccacaagttcaaaagtcttctatctttttttaaactctgtgcccagtcaaatgagttcacataaattaaaacggagggaataataaaaatgtattaaagactacttaggagagttcttaaaaaaccattttggaaccttgtctacgtacttttatgcaataactgcttaagtttgtctctgctaaaacctatgctccccaaccgtgcaccaatcagcttagaaatttgaactcaggaataaatgtaactacactccacagaaacttaaaaagttttactgttaccattcactcaaggatcagaactgaaaaacaaaagaatcagtgcttcactaaaagaaatactgtttacattattttcaaaagagtttaatcattaaaatagatgtaccatcagattagctaaaagataaataatcgttaaaaaaaggagattatcaacttgaaaatgaaacaaattatatgttataatatgtcaaaatatactgacagtataaaaactcgttaaatgtgttaaatcctatgaaaaaactgcccaaataaatatttgagcttaggtgtcaaatgttgtactcaacaacaataacaacaacgcattaggatcctactagtggggtgtccaatgttgtactattgaacattattcaactaacttttgttaggtgttcctgtagtttagtgaaattaaagtccactgttcccctatatattaatcccaaattaattaatcaagtgcagataaaaatttctcattttctattaatttattaagtgtaacaaactaaagaaattcaagaatcttgaatgatgagaaagagtcatgcatgtagaaaaatagataataatacatggaaatatatatgtatttggggatttgcatggtagctcaaagattattggaaagtgacaggaagataaatcaaaatctcagtgttatttcaaaaataaaaggcacagattatttaaataattgacagccagttttataatactatgtgggaggggacagagatcaatccatgtacgtgcatggctaatattaaagtaagggagaaaaaaatattaagttaattgatgattaaaaatagtaaaatttcagacgtatatcacggcaatgaagagtttgatctttaatatctgtataatggtccataatatgatggataggcgttgtttatgatatgattgattgatcattgatcattgactattgtttcttgaataattaatcagtatgggaaagggtcccattaaagttgaccatttgcttagcaatattatcttaggtaagctccatattagtttaatccacttgcgaatatattccgtcctcgcaaatcaatatttacaattcttttttttcagttttctatccggtatctgatacttgcattggtgttcgacaaaatctgtattcgcgtcaaaaaatttcatattatggggcaaaatgctccataataaaagcgactcaatattagggctcgaaccaatggcggaaacaagatttttactaagggaattcaaaaaataaaaacgaaaacacatgaagaacctcagggaattcaacatctaatataaatatatgaaataaaaatttgattctattgtaatttgatatacagtgtaatttacaccgtaggggatttggctaaacctccttccgcgtacctagctccgtccctgactcgaatccgaggtatttggttaaaaatgaaagagtacttctcataacctcgtcggtttttgtttctaatcaatctttatattgttaaaacataaaacgtttacttcctttcttcttcttttaagttttgaaaatgataactacttttgtttgactaatattttgtagtttttgatgctaatcaattttgtaaaaattactgtacttcaactagcgtttactaccccacctcactttaaaaaattccctaaagagataactttttgattaattcataaactaaattgaagaacttttcaaatgagagtaagttgaaaatgcatattatattgtagtatataattgcaattttgcataacttaccgtaaaatgttcttccttttaatgatttgttaatatgggaaatttgaacttttctttctttgaaattgtattcttgtcccatggtttctatgcaatctcaatcatcaaattgcaattatttttttttgttttttgttggcaaattcaggagagcttaggtcagtgatatatgaaaaactattttttactcttatttattttaccctttacttattaaagaataaagtccaagacgaatagacgatgtacaacgcaaatgtaaaaatacaaaaaaatgtttacgacttcttctctatttattttctacttaatttacttattaaacaagtacttacttgttaaactagctaatctgaccaacaatgtgaaaatgtttgacattatacatcttgactttttatttctctattattttctcgatggttacttcaaatcatagatttgctaatctgaccaatatcgtttaacttcaagtagaacgaaatgaacatttcaaggttttagaaaacagttgaaattggaccctaaaataaataaaatgaagttattaataggtttacaccccaatcttatctaatgcttaaaacacatagtgtggagcggaattcattgtcttcacattattgtacattaatcatattttcttaactaattctgacgattatttgtgttcatctaatagaaaatgcaaaagtcattttccttaatacttggcatctttatagtcaaaatataactcatatccaatgcaaaagtacagtcatgcacaacaatttaaagtattaggagcatttattagtttcacttgtttattaatgtaaaagtacgtagtaaaatgaaaggtaaactcaaaaatatcacatacatattttaatttgatcgatcaagtcagcttgagttcttgaactttgtgaaagcaatatatataatatgaatgaaacacttatgcattgcgacattgagagttaatttaagaaaattttaccccacaagttctagctttgattgacaggcctagccacaaagtaagatatgcacaatttatcttagtgcttctatgttgtgtatcaaaactcaacaagttatgtttagtactcctatgatgtttatcctaatttaaaagtcaatattaagtaaataaaaataaaaataaattaaagtctatgtatgtattctcttaccaatgcctatagtttaggcccagaacctaccatctccctgccaacccactactcttactggttttgcagaaatagttgctgatcaaatcatttatccaaagatctagtttcaaccttaaagatggaaggttcgagtcacttgattttgaagtattgacttaatgatgtactttctttaacataaggtgaaattagttgtggacttcatcgataatctgtcgttaaatcgtttgtagctaactaaaaatctatcgcgaaataggattaacgacgaatttttctgtttaactagagaattttttcgtcgctaattaattttttttttttgtagtgagtacatattagaaagaaaaaaaaaaaaaaaaaggaaagtgttgaagtcgtaatgtgtacaacatatgaagtccataacctgccaggtacaattctttaaagaattaaaatggaagaagaaaggtaaaagcaaagattgacaacaatttttttgtggctcgatgaaaattattagtgtcaaagaaagaaataaaggtaaaaaatggcagaggaaagaatcacctttgggaaatagccccttcacaaagactagagtccaaaattacaaacatcaaaagatctttggtcggttctactgtttgcatctcttgttgttgctttcgtcttgtgaaaaatcattgaggtactatgtaaatttataatcagttttttaatcttattgaaagtttcatagtgagaaggaatttat

SEQ ID NO: 157 - DNA, 5000 bp, Artificial Sequence
  Description of Artificial Sequence: Synthetic polynucleotide
gtactatcagaaaagatttaaatctaaccttcgttataatttgagtccaaatatacccctgatgctatactattggttcaaatatattcttttccattaagtttgtccaaagtggacatccaatcctacgttgcactgacatttgatgatgtgggtgtcacatggcttgccacctcagcgccccaaatccatatattagagactaaaatttgaaatacaataatttttcgtaatggtggcaatagtgatggaagggaagaaaattttagtggtggaaaaaaaaaatagaaggaaggggtaaaataggttatgagcgctgaggtggcatgtcacctcatcaaacgtcagtttttcgtaggattggatgtccaccttggacaaacttaacagaagatgggtatatttaaaccaatagtattacggcaatgatatattttgacccaaagtataacgaaagatatttactcatagtacaacgatacatttcgtcatttaccgaatttcgaatttacattctcaaagaactcataactttgatgttaactaattaagtttaaactttagatcaccctacaattgttgggagacatatcaaacccataccattgatatatataagaactttgtaaaactctttttaatatgttagggtatgtactagctagcaccatggatagtgcgtgtcaccattttacagcaaataatatgcctcatgaattggtagggaaagggtctttaaagttgaagtgtttttttctttttcttggtaggtagtgggggaggggaaaataaggggacaaaacacaaaatcaatttgagtacaatttacacaagtctccatatattgatatagtgctgaaaagaaatataatgttctaaggcaaaggggataacacttagaaattagccaacctcatgtttcttacaagtggatgagggttcgactttgcatttagcatcaccttattctctctaattttcaacaggacatgttaataaaaggatgacaatccagattgacaaagttatgaaagtgaaagcactgtaacatttcattcaatcatgcaagcatctcccgttaatttttctatcttttggaatattacgaaaatcaaaccaacctttttacgtataagtttctaatgacatcagggggactcctgagaaatattctcactcaaggtcgaaaaggaccctttaataatgatcaatataaattttttttataatggtcctttaatattcgaatcagctcgtacacatctcaatttttgtaatgagtacatgttatccccgacaatatatatataagataactttgccctcaagaatttatatcgacagataagagatcacataatatttttgtctttgttggaatgtaaactctacttttatgaaattttattaactggtaggtcacatcctacagagcttttagtcaatgttactattattaagaaggaaaaaaagaagaagcaaaaggaagatattaacaatagtataacaacattcataaacgtgatttaggaaataaagtatggaaaaatgaatagtgaaaaaaagtcaagtacttaggagttaaggttcgtaagttgatgggacagatcgcggtggaaaaggaagataagcttcaaagatacaaaagcaaaggggggttgggttgagattctgagttgtgattaataccactcatgaacaaaaagttatgtcatggcaccattcatgagattaagacaacggtggaattaagaattttattaaagggagtcaaattttaaaaaaataaattcatcaaaaagttaaagagtatcaatatatatcaatatatatatatatatatatatatatatatatatatatatatttatattaaattatctaattacacagtataatttttaacgaaagggtgtcgatcgacacccttgaatgcatgtggccccgccactgcattcagagccaactctcccccaaaagaaaaggcgcaaaacaaaaggatttgaaacagtagttgtggaggtgattcagccatgctttcatgactcatcaatacctactttttatgtttttctttttcctttttattttcaggatataaattttgttgtaaactgatataaagaaataaatttactctcttcaacctattaagcttttaggtgaaattagtaagtcgtacaatttaacatggtgtagaattgatagaagtcgtagacactcataggtgcactttgtagtgaaaattaggagaaattagggttcaaaatccaactaagataaaagatgcttggtaatttcttcacatctgcttagaaataatctgcttaaatttggatgagcaaagttatccaatacaagtgttgctgagaaataatcggtatctaatagaatagtcgagatgcacgcaaataagttttgactctactttaacaaaaaaaacaataggcagatgtatccaaaattcatatcttatggtcactcgtcaacaaaaatattccttatgtttagtccaagaaaaataaccatacccaaatataagggtttgttgaagacggaaatatataaacaaataaacaaatatcatcatatctccgatagtttaaaattttagattggatatttcacacaatttatcaaaattttcaaaaaaaaattctactttttcttgcttggaacttggaaggggaaggggtggtggtggagatagggcggggcatcttctatctagtctatgtgattaatataacaaaacaaaaagggcgaggcaaaaacatggatgaatggtggtccttttctatatttatatggattgttacgatacgtcgatttcactttgcaaaataccaattagattcatttagttatctttttgatcactctgcttttactatcatatatatataggagtccttccacgtttcgcatgtgtcattgtttatattttccatggtcttccttccaaatggctaaaaaaatttgacacagtggtcccaaaagtttatagaaatagaattcaacagtgaggcatatacctatgaattctattttacatcttcatcgtataaaatagaatgtgttataaactttacctcgtgatgcttacaaggggtgaaaatataaaagcactttatagatttacaagagtcacaccttgatttatcctaagattttatttttttacatgccaaacaatgaagtatgggagatccaattggaataacatcaaatttaataaaattcgaaatagtcagagagctgtctactgaggtatattgaaacttatttttttttaatagaaaatatcaaatacttagcaatatattaaaatgtttcataaattacattgtttaaaccaagcgttgaaacatatgctgatacgaggtaggcttattgatgaatttataagggcctcattggaaaagacgatccaaagcaatgggctaaaaattggcccattttctgccacccagtgtatggttattactagtttcacccacacagatttgcacttcattagaggacaatgttgctgaatttgaaacataagtccatttatctccactgtacagtccttcctggagtccaatcctgaccatatcttcatgattttatgtaatgtggtgaataagcaaagtttcatgttatgctttgtctcattttatagcaaattcatttcctcataaaatttacttcaaaaaagtttcgtttgattttcagaaatcaaaatatgcttttcggtaaccaaatggttttcaattttgtttacgaagaacttaaaactttccaacaccctacatctatgattgcaagttaaaattgcagaaatatgacactttttggagtggtctttatcgtttaacttcacttgcactttaagggcaaaagttaaaagtgtttccatgaagcaagcgagggataacacttattaaacttgaaattctactcatagaccaaaacaaggacaaaaattcaagactatctatgtgggtaaacgtacgaaaattgggcttctccagattagagccggaccttgtggaaagacagagaaattcgaggcccacttccagtttctaaggagattaagcctatcaaacgatggtccagaacgaaatatgtctttctttattctctactatatagctgactcagaatcgttagaatttgcaatttcctcataataaaatgtgaggcagtatagattcgaaaacctttgttgaagattattgactcagctacgcgaaacaaactgtagtatccaatgtaccgattaacaagcgactggttaactatgaatttgttagctcgacaaaatcaccggttaataatgagtttgtgagttcgataaaatctaattttctgatagaaattttatatattatgcagaaatttaataaaagtagacttaacttatatattttagcattgactcttttgaagtaaaatccattccatctaaattatgacttccctacatcgagtaagtaagttgcgtctgtatcctcattttacccacttttcgctatgcaattattcaaggatctttacacaaatagcaagccaatattaattatttattttttttagtcatatatataaattatacatatattatatacccattaattatttttaatttaagtgatagattggacgactatttggattaattcttcgttattcaagataatagatgtcgtctctaatacatgagctagaagataataaggattactaggccgaaaggctgatggaaatgaacaagaagataagctcctaaatggaaacagtacggaaaaagtcaaagagcagtgcatgggaggaatcatcagtcagaaaaggaagccacgtgtcaagtagaaacaagcacgtgtccatgcaaaagccacgtaactcccttccatcacatcttccttcttcaaaacctcgtgttttactctctcttttctcactgccagtgatcgtcaggactgtgcatgtttgtttaaaaactaaaggca

SEQ ID NO: 158 - DNA, 5000 bp, Artificial Sequence
  Description of Artificial Sequence: Synthetic polynucleotide
acatgacccggttgtctcctttgtggtgtctttcagaacatcgccagtagttcgttgatgtggtgttgagtgaatactttttcaatatataagcaatttcgtgccttttttggttcattttgaggcttatgtaatatatttgatcatgtaatcgtgaatacttcaataaaaggtaactcttcctcagataatgtaaccaagaataatttcattgaagggaagcggtataagcataaaggtaactttccctgtgatgaagaatgatgatatcaagtaggcgttgttgatcaactttccaaatgggtggagggtaagctacttcactgccttacttcctctaagttcaagttgggggaggtatgatcggggattctctatcttcttgttgaacaagaaaacagtactactacttagcatatatagtttcaatcaataaataggaactgtactaacaatcagagcccttattttcacttagcatagttgtataccagttagaactcatactgtggaaacagagactcgtggactagcaatgcccttattaaaaactatcatggatgctctactcattgtctctccaaacaacagcactctttcataaaaaggtacttcatgcgacatccattaatacaagaagttcaagatacataacatgcagtaacagaactcgactcaacttagacttatcccacatctagcttgattttccatcaaaccagtgtgcgtaaaagtaaaacataactatagaattgatcccatggttaatcacattcacataacaagcggttgggataaaaagatggtcagttctaaggcttcaaaattaatatagccaattagtcgaacggacggtgtgcaatcctagatgacttctatgaaagtgagacgaatcaatctcccaaaagtttagtacaaagaaataacagcaaccgttcaaacaatctaatacggctacacatattaatcttcacaaattaaacattacaacaaaagcatactaaattctgaactcagtaaagattcaaatcaacagcaccatattatagacataacaacactagtgaattggtcatcaaagcaacgaagagcacagaaaagttcgaaatttaaccaatcacgaacctgatcgaagctcttgtggaacatctacacgcttcctgacttgtggagacaagagtctcgagtagattcggaaactgcccagtctaattttgatacgtattctacaatttccttactaaagagaaaaagagaaagtgtgtgagaatataaaattggcgccttctttcttttggcgctatttatctagttttagcgaccagttatcatgatttttaaagatatttttagattgccaattttcgctgagaaaaaaaggaggtaaaaggggtggtagttaaaagtgataatcaactttatataagactagtcttaatatacgtgcgttgcgcgtgtcataaaaaatattttaaaaaatatatttgtgttataatataaaaattaatacaaatttgcaagcttcaaaataatgaattaatcatatttaggagtttgatccactctagtggtttttggttcatcttgcttcattgtacaaaaaatttgagtatacttccaattctaagtcgttctattgttcaaaggaaaaaaagtgtcctaattgctcttcaacttctaaaatattgcctatctcttaccttaaatatgaattatcatttctgcgtccatattttttttttaaatcaaaattgtctttttcgtttttttttttttagaaaactatactctatagcccacaaaattttaatagctcatgtcttttctcacttacacgaaatggccctttggcccaaacataatagaccgaaatgtctattttgtatattttttgtatagtgacagtctattttgaatatttttttatataatgacagtctattttgtatatatattgtatagtgacggtggggagtgggttgctctagtggtaagcaccctccacttccaaccaagaggttgtgagttcgagtcaccccaagagcaaggtggggagttcttggagggagggagccgagggtctatcagaaaagcctctctaccccagggtagaggtaaggtctgcgtacacactaccctccacataccctactagtgggattatactggatcgttgttgttgttgttgttgtattgtatagtgacggtctatttagtatataattgtatagtgtttgtatattttttgtatagtgacagtctattgtatataaattgtacagtgacagactattttatatattttttgtatactgacagtctattttgtatatatgttgtatagtgacaatctatttattactccctccgttccaatttatgtgaacatgtttgactgggcatgaaatttaagaaaaaataaagacttttggaatttgtggtcctaaacaagtcaaaaggaggtccagagtatttgtggggttataaaagcttctcattaagggtacaattgtaagtttaagctaaattattatcaaatttagaaaagggtcattctttttggaacagaccaaaaaggaaataggttcacataaactggaacaaatggagtatattttttgtatagtgagagtctatttttcatacttctatgctaagtattgactttaaacactgttcaaacttaaacgtgtctctttcgcgtgaaattactctatattgaactactacaactatttgtgccggattttgtcaaaaaattcaattttccggccaagttcgttctgcttcctcctcccatccttccaatcttattctttctgccacttttcagcaatagtgatacaactaagatatgttttaaggttttgaactatttgtgtggaagagttttatggcatatactttttctttggtcgttgagaagagaggtcgacgtcgctcatgaagacattctgccgccgacgaaacagatcttatagctagccgctagaattattttaggctataaaatgtatattataattttggactactggatgatatatgttttgggccgatgggctataaatgaattttgctcatttttttaacgtgttctttattagcataaaaattgcaggatgagtttgttactttaatttcattaatttactctttttttgcagaatatacatacatgaaaagtaacatgtagtaaatattattatgttacatatatagtttaaataaaggaaaaagttaatgtaaggtagaattttaattgactttaaattcctaaattttaggacttctcacctagttcaaataagtaaatatttaataatcagcatcttagttaatttcaaagtactaaatattatgataataattaaatgactattttgtctagtcgaaatctattttttaagggtaaaaaaagcgaacgatatttcgctaagaaccttcgtgcttttaatataatactagtttctatgtacgtgcgttgcacgtaaatctttagtttatcatttatatgaaaaaacaatacattaaatttactggaaaatcatatacaaaaagaccgaataaagccattaatgtgggaacaatgcaatagtatcgtcaatgggaacatgcattgcacatatattccgtgtcaatagttatctttgtgaaataaaaaatgatacatgtaattttatactatcattcatattatgaataaacttgtttgatttttaaaatagaaaataataaagagcacgaaaagttactgctagtcattaaaatttgttatgaacattgactctattatagaataactcatcaagaagaattttaagtgcaatattgaaggatttgctttagtttctaatagtataaatcgatgtctcttatcggatcataaaaccaaaagaactataatgtccatacaactccctatgtatgtttacaatttgctttgtgtgtgtaaacattagaacttttcacctaaatatctcatacctcttaagaaagaatccttgctggatacttttcttttggagcttcacaattataagttaccaattaactaatctctccaagcctctatttaacatatacacgtttatctctggacgaacaaacaatagatggcgtcgaagatccactcttcatcttcctgattttcatcaacttccttatgcctatttatttcttgttttcagttaattcgacaaattaaattagaacaaaatccattactgctggttatcagacaaagaaaaactaaagtaactccttttgccaacaccaatgtagaacataaataagcttaaaggtaatttcttttaaattttaggcaaaacctttatgtaaacgaacatttaagccgtggctttgccattggagttctaatacaaataggacctttagttttcaatgacttgaattctacaactaatgaactgtttttacgtttttggatattaatgttgaagacatgatttaaatatgaagggtaaaaaagtcggtcaatatttcagggacatttttgtcgttcaatatttagcgtgtaacattcgtgtttttataataatatagatatagatatagatttctctccccaaccccgagattttttaaaagtattttaaaatagggttactgtgcacatataagaatcagaaatttccaggaccatagcaatgagcattattgaacagtagtagtacgtatgtcctttctggtataggatatgtagcttcattaaaagatagaaaatgaaaagcgtataaagtttgtgatacatttactaataaatccaacgaataaaagaaatactcgtatataaaagtagaaaagtaagtgtttgtactttttataaaaacacaataggtggagttgagagggatatggaaattgccttggatattatgtaggcatcatgaaccaattaatgggacctacaagattaatgttttggctatccttatcttttattgacaggcccttcaatttaaatcgttgctgcccaa

SEQ ID NO: 159 - DNA, 5000 bp, Artificial Sequence
  Description of Artificial Sequence: Synthetic polynucleotide
ccgactaacaaaggagtcaaacaatggcgaaactagaaatttacccaagggtattcaaatttaaaaaaagtgaaaacaaattcctacaaagggtgtttaatatgtgttatatacttctaaaacgtaatatttatctataaacacaatgcaatttttcaacgaagagtgatcaactgaccaccttataaccgccactggagtcaaaccctagttttcttttttagcttctttgtattattggtagaggtgaaccattttatacaaacatacatacatatatgtgtgtgtgagagagaaactttataaaaatagtactatgaatattgaatatcgaatttccattctcaaataactcataactttaatgttaactcattgtaaaaccttttttttacatgttagggtctgtactagctagcaccatggatagtgcgtgtcaccattttacagcaaataatatgcctcatgaattggtaggggaagggtctttaaagttagtgtgtttttttttctttttcttggtaggtggtgggggaggggaaaatgaggggacaaaaaaaatcaattggagtacaatttacacaagactccattgtatagtgctgaaaagaaatataatgttgtaaggcaaagaggataacactttagaaattatagccaacctcatgtttcttacaagtggatgagggttcgactttgcatttagcatcaccttattccctctaattttcaacaggacatgttaataaaaggatgacaatccagattgacaaagttatgaaagtgaaagcactgtaacatttcattcaatcatgaaaagcatctcccattaatttttctatcttttggaatattacgaaaatcaaaccaacttttttacgtataaatttctaatgatgtcaggggaactcctgagaaatattctcactcaagttcgaaaaggaccctttaataatgatcaataattttttttaatggtcgtgtaatattcgaatcagctcgtacacatttcaattattgtaacaagtaccttttatcccccaacaatacatatataaggtaacttatcacgtaatatttttgtctttgttggaatgtaaatcctgtttttataatttttatccactttattgaccgctaggtcacatcttatggagcttttttagtcatgataaatattactattattaagaagggagaaaaaagcaaaaggaagatattaacattagtataacaccattcataaacgtgatttaggaaataaagtatgaagaaatgaatagtgaaaaaagtcaagtacttaggagttaaggttcgtaagtagatgggacagatcgcggtggaaaaggaagagaagcttgaaagatacaaaagcaaaggggggttgggttgagattctgagttgtgattaataccactcatgaagaaaaagatatgtcatggcaccattcaggacatacagagccaactctccccccaaaagaaaaggcgcaaaacaaaaggtttgaaacagtacttgtggaggtgattcagccatgctttcatgactcatcaatgcctacttttttttctgtttttgtttttcctttttattttcaggatataaagtttgttgttaacttaaataaagaaataaaattactctcttcaacctattaagctttaggtgaaattagtaactcataaaatttaacatggtatgaattgatagaagtcgtagacacccataggtgcgctttgtagtgaaaattagggttcaaataagataaaacatgcttgatgatttcttctcatcggtttaagtttggatgagcaaagttatccaatacaagtattgccggtacctaataaaatactcgagatgcacgcaaacaaattttgacactactgttaacaataaacaatatgcagctgtccaaaattaatactatatcttattgtcactcagtcaacaaaaatattccttatgtttagtccaagaaaaataaccatacccaattataagggtttgttgaagacagaaatatataaataaatgaatcatcatatctccaatagtttaaaatttcaaatgggggtatttcacacaatttatcaaaattttaaataatttttatactttttcttgcttggaaggggaaggggtggtggtggagatagggcggggcatcttctatctagtctatgtgattaatataactaaacaaaaagggcaaggcaaaaacatggatgaatggtggtccttttctatatttatatggattgttacgatacgtcgatttcactttgcaaaatacccactagattcatttagttttctttttgatcactctgctttttctatcatatatataggaagtccttccacgtttcgcatgtgtcattgtttatattttccatggtcttccttccaaatggctaaataattttgacacagtggtcccgaaagtttatagaaatagaattcaacagtgaggcatatacgtatgaattatattttacatcttcatcgtataaaatagaatgtgctataaactttacctcgtgatgcttacaaggggtgaaaatataaaagcactttatagatttacaagagtcacaccttcttgatttatcctaagattgtatttttttacatgccaagcaatgaagtatgggagatccaattggaataacatcaaaattaataagattcgaaattgtcagagagctgtctactgagatacattgaaacttatttcttttgtacaacagaaaatatcaaatatttagcaacatattaaaatcttcataaattacattgtttaaatcttacgctgtaacatatgttgataggaggtaggcctattgatgaatttataaggtgaaaatacatggactagccagttttcgaactagtaattgaaaaaaggtatattatcacttttagcccgcgccagaaattatttatatttggtagttgaaaaagtgtataaatttgtaattttttgtatataacacacataatgtgtgtgtgagtgtatatatatacacacacaaaaactatatatattttttctattattttgagagtggttatacagtgtcatctttctaatcgaaaatagccagcgtttgcaatgttattaaaaaaaaatagccactattttagctgaaacacggaaagttccagcataatatatcggatttcagagctcctgcatataaacttccagcacattatgaaattccatcacattatgctgaaatttttccggattcttaaggtgttttcattcagattttatctttacataaaaaaatggctaaatttcgattacttttgaaattatagctctttttcaattactaattataaatctgactatttctgattttttgcctctggtcaaaatggcatggcatagtcatttttaggggtggttattgaaaaatagctagtattcacaaagttattgaaaatagtcattatttacggcgaagattaaatcttaacaaatgtacctgagttaaaacacaaaaagttacaacataatatgttggatcatggaactccttcatgtatgcttctagcatattatgttgaaactccagcacattatgaattccaacacattatgtcgaaatctcatatgtaaaaaattcgaactctggcatattatgctggaattttttcgtattttttatcagattttattttcacataacaaagtgactagatttcaataacttttgaaactatgaccaattttcaattaattgtaaatcaaattatttctgatttttttcctccagggcaataatgggactcaactttaggcaacaaaaaactgtttatgtaggtaaacgcacgaaaattgggcttctccagattagagccgggccttgtggaaagacaagaaattcgaggcccacttctagtttctaaggagattaagcgtaaaaatagcactggctagccagttttcggactgatcattcaaaaatagccagtatttgcaaagtcattgaaaaatagccattagtattttgctgcaacacgaaaagttccaacataatatattggagatcagtgcacctatgtatgaacttccagcatattatgctggaactccaacacgcggaaagttccactataatatactggagattggagcaccggtgtcaacaaatctatcatttaataggatttatggctatttttaaatgaccacttgtaaatctgattattttttaatttctcccgcttaagcctaaccaacgatggtcatgaacgaaatgtctgtttttactctctactatatagctgacccagaatcattacaatttgcaatttcctcataataaaatgtgatgtagtatagatttgaaaacccttgaagattattaatttatctttcgcgaaacaaactgtagtatccaaggtaccgaatagtaagcgattggctcacaatgagtctgtttgttcgataaaatcattggttaataatgagtctctgagttccatacaatctaatgctctgatagaaattttatatatatgcagaaagtaataaaaatagactatgacttactatattttaacattcactcttttgaagtaaaatcccttccgtcaaaattatgacttcattacaccaaattgcgcctgtatactcattttaccttctcttcactatgcaattattgagataaaaaatttcgtctctaagacatagctagaggataaggatcttaggccgaaacactgatggaactgaacaagaagataatcacctaaatgggaacagtacggaaaaagtcaaagagcagtgcatgggaggaatcatcagtcagagaaggtagccacgtgtcaagtagaaacaagcacgtgtccatgcaaaagccacgtaactccactccctcatatcttccttcttcaaaacctcgtgttttactccccctttcctcactgccggtgatcgtcaggactgtgcatgtttgtttaaaaattaaaggcg

SEQ ID NO: 160 - DNA, 5000 bp, Artificial Sequence
  Description of Artificial Sequence: Synthetic polynucleotide
acatgacccggttgtctccttggtggtgtcattcaaaaaatcgccagtagttcgttgatgtggtgttgagtgcatactttttcaatataagcaatttcgtgccttttgtttttccattttgaggcttatgtagtatatttgatcatgtaatcgtgaatatttcaataaaaggtaacttttccttagataatgtgaccaatgatgatctcattgaagggtatacttttcctgtgaagaagaatgatgatactcctatcatgtaggcgttgttgatcaactttcccaatgggtgaagggtaagctacttcactgccttactttttctaagttcaagttggtggaggtgtgattggggatcctttatcttcttgttgaacaagaaaacgctactaattagcaatgaataggaactgtactaacaatcagagcccttattttcacttagtatagttgtatgtataccagttagaacctatactctggaaacagggactcgtcaacaataaccagaagggtggattagaaactatcatgaattccctactcattgtctctccaaacaacaacactcttttataaaaagtgtactgcaagaatcatgttatgcttttaaggaatgtgcatcaagattgaagtatcatgcgacatccattaacacgagaagttcaagatgcacaacgtgcactaactgaagtcgactcaacgtagacttattccacatctaacttgatctttcataaaaccggtgtgcgtaaaacattactatagaattgatcccacggttactcatattcacacaacaagcaattgggacaaaaagatggtcagttctaaggcttcaaaattcatacagccaattagtcgaacatgcggtgtgcaatcctagatgacttctatgaaaatgagaccaatcaatcttccaaaagttcagtacaaagaaataacagcaacccttcaaacaatctaatacaacgacacatattaatcttcacaaattaaacacaacatcaaaagcgtactagattttgaactcggtaaagaatccaaatcaacagcaccgaattatcgacataataccactagtgaattagtcatcaaagcaacgaagagcacagaaaaagttaagaaatttaaccaataacaaacctgatcgaagatctcttagaacatctacacgcttcccgacttgtggcgacaagagtctcaagtagactcggaagctgctcagtctaattttaaatatatattctacactttcctcgcaaaagagaaaaagagagtgtatgagaatattaaattggcgcctttttcttttggcggaattgttctagttttagcgaccagttatcatgattttactactatgtaaatcgcaagcattaaagttatagcaagaaatgagaccgagtgacctaaaaacaatcacatttgtatgtttcggttccacgagcagctctgggcggacctagtaggagctcctttgcactgttgcaggagtgctcaagtacctttactctcttggtgactcagacactactgccatatcaatgagaaaaaaggaggtaaagtggtagttaaaagtgataatccattttatataaaatccctccccccgcccccatacccccggaattgtaaaaatatttttaaatagtgttactatgcgcatatactagtcagaaatttgtaggattacgggaggtagtacgtgcgggtgtacaaaccaaatcggaaaatcgcaccaaaccgaaaagtcaaatcaaaaccgattaaaagattcgactagatttggtttggtattgagtaaaacaacccgaattaaaccgacatataaatataaatttttatgtatacttttaagatttttatatagaattttctttaagaaaatatctaaaaatatttgggattctcttacgggatataatatttaataaaatatgaagtgctccatatttattaaccttaaacaatgggtcgtatgatcactttcttatcaagtgttactgaaatgcgtcaatctctttgttcttccatagtcaagatctattaaattcttatatctttttcgaatttgaagtggttattattatttaagtatcatattgacttttacgtttaattactaaattcggttaaccttgaaagtgtatatcaacaaaaattattgtcggacgactaaaagactaactatcatgtgttattaagtaaattcacgcataagaatatttaatagataatatatttttctaatttttaaaatttttactaaatatatttacttataaaaaatttaacaaagtaagattgaaataatatttaagtaacgaaaaaccagccaaaaccgatatagtttgtgtagtttgatttaaataaaagtcgaacccaacccgatccatgtacacccttaatagtacgtatgtcctttctggcatactggtaggatttgtagctgcattaaagatagaaagcgaaaatcgtacaaagtttgtaatactagtacattactaataaatccaacggataaaagaaatatataaaagtagaaaagtaattggtctagattttatgaaacacaataggtggagttgagaggggtatggaaattggcttggatattatgtaggcatcatgaaccattaatgggacctacaagattaatgttttggatatccatatcttttgttgacaggcccttcaattgaaatctttgttgcccaaaatgattccactgtcaaccaattataagttttttgttaaaaggtttattgcaccattgctccactaacttcatgtgcatttgcaacttaccacacaagagagaagaaaagtttccagtacacaggattaacatttgctaagttgattcggagttttagttagcaaagttgaaattatcaaagacagattttgaaactataagccagtggatcgctaaggggttcctcgttgataaatacttattttcatctggtgtttatactaatccaataaatatataatatatgtctttacaaatatggttataattaaatcataattaattagtacacattgttacctcacgttatcactttaccatgataagagtttggtataaatactggtgggactaagttttttaccttcctcgtttagtgtctacaagcctaattaggtgaagatggtgctggatttttttttttttttgttacaagtgtagactacagaaattaaattactggtcctattgtgcaaaatttgaattcaaatcttcgtgcatttcagtatgttatttggtacaaaaaacatggcatttatggcttcgcattgaggaagaacttgtatatagcttgaatgctcttgttacatccaccctccttaaatacccctagttgatcaacaggcaccaaaaatgtctagacacaaacatgaaccagttttatttctattctctttattgtaggtaattgtttgctgtcatcatataatataagctaggaagaaaataagtaaaaatcatcagatgtgataggtcttgaatagagaagcaaacctaatgtagcataataagaaaggaagattaggtgggagaccattatttatgacctcatcccaattttaatcatatttcattattccaggttactactaccaaacaaaaataaacgacaagaataatgcataaacttccacaatagctcattatttatttatcagccggagtgtattaaagtaatgatataattagaagacaattgagttgctacttaaactgatgctaacctgacgcgttttcgttttccaggtacagtcttccaacatcagatgtcccaattggagttccaagtcaaagtggaattggaaaatggtaagaaaactctcagccttagctgtgacatagacatcaataaagtagaaaaaaatcataagatttcaatgtttgaatgctaagcgacacaaaaatcactaaataatttttttcatttctgactaagtctttatgagcaaaactatttattacttacaattttgtgatgataggagatatcaaatactcgtggaatacttgaggtacccacaaagtgattgagaagttgctgttaattaaaaaatccttgcatcagatcccttcagtttgaggtcaaaagcacaatcatgaaaagccctctcacagcacattcacttgatccattctattttacgtcttttctctaactacgacttaagttcttctaacttttaatcattaccaccctattaaaacttatctaaagactgtttttctctgcttttctccatatttacctcaacgtctccttccatatccaagctttggtactttttccccttgtggtattgattcaggcatggtcccttctccaatcttatcaatcaaacatatactaataaagtataatataccaccgactttggtgtcaaccacgagttcgggagcttgtgaaatatggtggtatttagccaatttttttctttttaataaaattgacaattaggaaccaacttgccggcttcataataaagtatatagttgaaatggttcagaaatattaaattcaattctataaattacttggattcggtccatcctaaaggtggtcacttctaggatcaagccccattgttggctaaattttggttttaaatagattaattagcttggagtcgaacagcaagcattaagtttaccaggtctatgatttagttaggcatgaattgtaatacaaagatgatttatgcagtgattaatgatatcaggatatatatatataagtattgttatactataaataacaacaacaacaacgacccagtaaagtcccactaagtggggtttggggaaggtagtgtgtacgcagaccttatccttaccctgatagggcagagaggttgtttccgatagatcctcagctcaggaagatgaaaataaaacaagaaaacaagaaaagacagtaaccatagaaataatgacagcatcctaaaaaccataaaatagatga

SEQ ID NO: 161 - protein, 524 aa, Artificial Sequence
  Description of Artificial Sequence: Synthetic polypeptide
MIGYPKRFTLHGLWPANSTGYSLKCAPPPEGTSVWTTDGQLRTALQKCWYSLIRGRPNYILWKHEWKDYGYCSSHTIKDTDYFWAAVRKHGRNTKIAGDAIVNELSDAEISPSNDKERRCETESDSSHHYQHSEHHQRRWLGRRRECDTKRYSQAKYITSPHESVTASREKRASTSTIEEAPPAVKKLLLEWLTSTINNIFDKPAQKENGNTAQADIVTTTGEQPLPRTGNTYPTMDAGAKKAEARVNDIFAVRQSSGEGLRDFLARFNREEIHNAYCAKERADDDDLNGPIQRLTSVQEESRSDHRNDSQRDQSGPRLSRERHQHYVRTTVLPSPRHMEGPPRPYIGTQRNERGMPPLLSTHNFCVSPSKIVYALKKLGTMVKCPQKMKSGPNTQKLNAICEFHQERGHKTEDCIGLRQEVVRMLNQGNLKELMSDRGRVNFARGRELPQGPPKPPSPARTIQMIIGGGDEAMINHMKFTTTHKLKRSMTHERYDDFGDSIIFDKSDTDGLTFPYFEAIVITL

SEQ ID NO: 162 - protein, 343 aa, Artificial Sequence
  Description of Artificial Sequence: Synthetic polypeptide
MSCQNSKTEETADEQHNTSKDPKHKPFFDVYGPQGRADIVFNQPESNSTLNLQDVQGLVTWVLADGFMPSWAFIKNKPLIPKVVMLYVPGLDAALYLSQSKVLKGFKECCGIPRPVLALSCVSDGNQTIDALLTYKSKRKRKEAEHISPINTEPSEQGAETPTMEPLSFVDLKKDIPFPISYYTLTDKELEENGYCYDQPEFLSTLPAPSGTSPHEILALDCEMVLLDKLVKPSNNIVDYNTRYSGITCQMLEDVTTTLKDIQEEFLKLVYKETILVGHSLENDLLALKIIHNLVIDTAVLYKHPRGSYKAALRVLSRKFLGREIQDSGNGHDSIEDAKLHWN

SEQ ID NO: 163 - protein, 723 aa, Artificial Sequence
  Description of Artificial Sequence: Synthetic polypeptide
MASTSYITFKPLQQTQLKLYYFTHCSKHSSTLFHSSFHTLLSAPTKYTLEPPRILPSIQVKAHVTHLETRLSFEPEQEISGSRTNNENSSGFSSFSPKDKMVGMKSSRENLDRHCQTLDELVQLFKSSAEASNTKSVRGEQEDHGIKVSEEVKHYALKYGFKIYEKMRSEKVQMNEATLTSVARMAMALGNGDMAFDVVRLIKEYGINPRLRSYGPALSVFCNNGDVDKAFMVEEHMLEHGVYPEEPELEALLKVSVEAGRSEKVYYLLHKLREGVRQVSPSTADLIEKWFNSKIASRVGKRKWDERTIREAIKNGGGGWHGQGWLGNGKWTVSHAYVDSDGCCKCCGEKLVTIDLDPVETENFAKSVASIAAQRERNSSFQKFQRWLDYYGPFEAIVDGANVGLYSQRKFRPSRVNAIVNGIRQMLPSKKWPLIVLHNRRITGDKMDEPFNRAYWLYAAIKFKCLIVTNDEMRDHLFQLLGNDFFPKWKERHQVHFSFSETGPVLHMPPPCSVVIQSSERFGPDRRIYHGRSSRTLKDKELSGSRDSGYPRLSDYNFNINLIELVSVMRNIKEARFPKPIRSYSSQKDHFKIKRVLVDPGSSANIIQLRVLEQAKLIEVPTMKLLAGFNLTSVTTQGEIVLPTYAEGVTKSTLFKVVDGDMGYNVIIGRPWIHKIKVVPSTYDQFLNFPTSDGIKQIRGDQPAAREMNVVTLSSSNAEEINK

SEQ ID NO: 164 - protein, 155 aa, Artificial Sequence
  Description of Artificial Sequence: Synthetic polypeptide
MQSPESCVIVSCPTTLIADEDEEVADMETSVKAVEEILNYKFIKPKLLEEALTHSSCIDSVSYQRLEFVGEQAEFHGGAMKAPKVLADIVESVAAAVYVDCGFDLKNLWLLLLRTKKMLTSRCKAALQKLAFKSIGKTDLKLNQIQRLMGQAKAA

SEQ ID NO: 165 - protein, 234 aa, Artificial Sequence
  Description of Artificial Sequence: Synthetic polypeptide
MKPQKSLLIKVLITQCLLVLCVAQQDFDFFYFVQQWPASYCDTRRSCCYPTTGKPDEDFSIHGLWPNYENGKWPQNCDRESSLDESKISDLISTMEKNWPSLACPSSDGVRFWSHEWLKHGTCSALGERAYFQAALDFRKKSNLLENLKNAGITPRNGEHYTLESIKKAIEEGVGHSPYIECNVDTQGNHQIYQVYLCMDKTATDFIDCPVFPHGRGCGSKIEFPPFSSDHDEF

SEQ ID NO: 166 - protein, 217 aa, Artificial Sequence
  Description of Artificial Sequence: Synthetic polypeptide
MATRRREADFDFFYFVQQWPASYCDTRRSCCYPTTGKPDEDFSIHGLWPNYENGKWPQNCDRESSLDESEISDLISTMEKNWPSLACPSSDGVRFWSHEWLKHGTCSALGERAYFQAALDFRKKSNLLENLKNAGINPRNGEHYTLESIKKAIEEGVGHSPYIECNVDTQGNHQIYQVYLCVDKTATDFIDCPVFPRGRGCGSKIEFPPFSSDHDEF

SEQ ID NO: 167 - protein, 160 aa, Artificial Sequence
  Description of Artificial Sequence: Synthetic polypeptide
MGVTTYNQEVTTLVAPTRLFKALVLDSENLVPKLMPQVVKNIEIVVGDGDAGSIKKMNFVEGSPIKYLKHKIHVIDDKNLVTKYSLIEGDVLGDKLEFVTYDIKFEASGNGGCICKTSTEYHTKGDYVFKEEEHYEGKKQAMELFKTVEDYLLANPSVYV

SEQ ID NO: 168 - protein, 160 aa, Artificial Sequence
  Description of Artificial Sequence: Synthetic polypeptide
MGVAIFTQEFTSPIAPIRLFKALIVDSKSLIPKLLPQFVESVDLLQGDGGAGSIEQVNFTKGSPFEFVKHRIDELDKENMVCKYTMIEGDALADKFDSISYEVKFEESNNGGCICKMTTEYIGIGDFIVKEEDIKAGKDSAIGIYKAVESHLLQNPNLYA

SEQ ID NO: 169 - protein, 160 aa, Artificial Sequence
  Description of Artificial Sequence: Synthetic polypeptide
MGVTTYTHEVTTSVAPTRLFKAIVLDSENLVPKLMPKVVKNIEIIEGDGGAGSIKKMNFVEGSPNKYLKHKIHVIDDKNLVTKYSLIEGDVLGDKLEFVTYEIKFEASGNGGCICKTSTEYHTKGDYVFKEEEHNEGKNQAMELFKTVEDYLLANPSVYV

SEQ ID NO: 170 - protein, 160 aa, Artificial Sequence
  Description of Artificial Sequence: Synthetic polypeptide
MAITSFTDEYTCPIPPSRIFKASIIDSHNLMPKLMPQAIKSIEFVQGNGGAGSIKQINFPEGGNFKSIKYRIDELNEEKFVYKYTLIEGDALVDKLEKITYEVKFEQSADGGSISKVTSTYYTEGDFKLKEEEIKAGKEKVLGMYKAVEVYLLQNPDAYA

SEQ ID NO: 171 - protein, 229 aa, Artificial Sequence
  Description of Artificial Sequence: Synthetic polypeptide
MASNSATSLFLTLFLIIQCLSLLTAAQDFDFFYFVQQWPGSYCDTKQSCCYPKTGKPASDFGIHGLWPNNNDGSYPSNCDSNSPYDQSQVSDLISRMQQNWPTLACPSGTGSAFWSHEWEKHGTCSESIFDQHGYFKKALDLKNQINLLEILQGAGINPDGGFYSLNSIKNAINSAIGYTPGIECNVDESGNSQLYQVYICVDGSGSNLIECPVFPRGKCGSSIEFPTF

SEQ ID NO: 172 - protein, 229 aa, Artificial Sequence
  Description of Artificial Sequence: Synthetic polypeptide
MASNSATSRFLTLFLITQCLSVLTAAQDFDFFYFVQQWPGSYCDTKQSCCYPKTGKPASDFGIHGLWPNNNDGSYPSNCDSNSPYDQSQVSDLISRMQQNWPTLACPSDTGSAFWSHEWEKHGTCAENVFDQHGYFKKALDLKNQINLLEILQGAGINPDGGFYSLNNIKNAIRSAVGYTPGIECNVDESGNSQLYQVYICVDGSGSDLIECPVFPRGKCGSSIEFPTF

SEQ ID NO: 173 - protein, 240 aa, Artificial Sequence
  Description of Artificial Sequence: Synthetic polypeptide
MRSIQLVLVKLVIFQCIMLLHAQDFDFFYFAQQWNPASCDSKIKCCYPTNGKPAQDFGIHGLWPNYNNGSFPKSCNKNARYDETQISDLISSMQKNWPTLSCPSNNGTRFWSHEWKKHGTCSLSMLDMHSYFQAALALKEKVNLLQFLNNAGIKPDGGFYSYEAMKEAIEKGIGHTVGVECNIDLFGNRQLFEVYVCVDKCGSEIIDCPIVPESKRCKESIEFAVFESESLLDEKSAYSL

SEQ ID NO: 174 - protein, 265 aa, Artificial Sequence
  Description of Artificial Sequence: Synthetic polypeptide
MRSIKFVLVKLVIFQCITLLVHAKDLDFYRLTLQQWNPAACYNRIIGKCCNTTTGRPAEDFGIAGLWPSYNNLTYPENCNKAGPYDETQVSFDKIQISDLLSSMQKNWPKISCPSNNGTSLWAKEWKERGTCSRLNMHSYFETALDLKEKLNLIQDVKRYGTDLTHVHMHGLEPNGQFYHWRHINAAIKLAIGHVIAIECNLGLTADSQFYRVHICVDKSGSDFIDCPINLTEISETTCSSSTKWSGYDTDSVLEERSAYSWARK

SEQ ID NO: 175 - protein, 493 aa, Artificial Sequence
  Description of Artificial Sequence: Synthetic polypeptide
MGSFSFAVCVSLMLLVMVVAIPFEPKNGRRIGRLHRWWDPLIRSPVDRDDEVEDSNSVRWAVLVAGSNGYGNYRHQADVCHAYQILKRGGLKDENIVVFMYDDIAKSELNPRPGVIINHPNGSDVYAGVPKDYTGEHVTAANLYAVLLGDKSAVKGGSGKVIDSKPNDRIFLYYSDHGGPGVLGMPNMPFLYAKDFIEALKKKHAAGTYKEMVLYIEACESGSVFEGMMPEDLNIYVTTASNADESSWGTYCPGMDPPPPPEYITCLGDLYSVAWMEDSESHNLKKETIKQQYEKVKERTSNFNNYNAGSHVMEYGSKEIKPEKVYLYQGFDPATANLPANKIDFAHLEVVNQRDADLLFLWERYKKLADNSLEKAKLRKEITDTMLHRQHLDGSVDAIGVFLFGPTKGSSVLNSVRKPGLPLVDDWDCLKSTVRLFELHCGSLTQYGMKHMRAFANICNNGVSRDAMEEAFMAACNEHKIEEYIAANRGFSA

SEQ ID NO: 176 - protein, 494 aa, Artificial Sequence
  Description of Artificial Sequence: Synthetic polypeptide
MGSFSFAVCVSLMLLVMVVAIPFELPKNGRRIGRLHRWWDPLIRSPVDRDDESEDKDGVRWAVLVAGSNGYGNYRHQADVCHAYQILKRGGLKDENIVVFMYDDIAKSELNPRPGVIINHPNGSDVYAGVPKDYTGEHVTAANLYAVLLGDKSAVKGGSGKIVDSKPNDRIFLYYSDHGGPGVLGMPNMPFLYAKDFIEVLKKKHAAGTYKEMVLYIEACESGSVFEGMMPEDLNIYVTTASNAEESSWGTYCPGMDPPPPPEYITCLGDLYSVAWMEDSESHNLKKETIKQQYEKVKERTSNFNNYNAGSHVMEYGSKEIKPEKVYLYQGFDPATANLPANKIAFAHVEVVNQRDADLLFLWERYKKLADNSLEKAKLRKEITDTMLHRKHLDGSVDAIGVFLFGPTKGSSVLNSVREPGLPLVDDWDCLKSTVRLFELHCGSLTQYGMKHMRAFANICNNGVSRDAMEEAFMAACNERKREEYTAANRGFSA

SEQ ID NO: 177 - protein, 768 aa, Artificial Sequence
  Description of Artificial Sequence: Synthetic polypeptide
MYDDIANNSENPRPGVLINNPHGQDVYQGVPKDYVGEDVNADNFFNVILANKSGITRGSGKILDSGPNDNIFIYYTDHGGPGIVSMPTGIVYANDLINVLEKKHASGTYSKMVFYLEACESGSMFDGLLPEGLNIYVTTASKPDENSWGTYCGLGRGACLVECPPPEFDGVCLGDLYSVAWMEDSDVQDRQTSTLDNQYDRIACRTAANLTYGSHVMQYGDMELSVDALFQYMGSVSTSHSQAPSPMAAAPSPMDAASFLTSSENVNQRDTELFYLTSKYQGAPEGTNEEFAADRKLNEVVAQRSQVDNNVKRLGELLFGVEKGNEVLQSVRPAGQPLVDDWDCLKSYVKTFEAHCGKLTAYGKKHVRGIANICNAGIESEEMVDATAQACSAASEIGPNSPTFTQTDFILPPSHPLYLHPSDNPDPDISQSVIYSKSAKRLWDKLNQRYGQANGAKMYEVQKDLSTIFQGSSDVGSYFTRVKRLQDEMESLDADSFCVCECKCGGKHKMIKRMENQKLMQFLMGLNEERGYDPKMPYCRYCKKPGHVIEKCYKLHGFPRPSKSGNKNIRVAAHVHSSSDAKPNRSYDNNINIANTIIPDQYKQHMTILQHIQVGSNDSQSQFATANFAGIFASSAHLMSCGNCTCLSSVLTSETWILDSGTSVHMTFNKYSLTNITTLYVPYLITLPNGYKVKVTTIGSVKLNSSVILSKVLYVPTFKYNLILVHKLLVDTLSLLCFSQHACFLLHGPSLRMPLILGKCHNPKSHPS

SEQ ID NO: 178 - protein, 457 aa, Artificial Sequence
  Description of Artificial Sequence: Synthetic polypeptide
MVQKNGVVSFLVVLFVIVCTAEGRNLLESIVEDDNATGTKWAVLVAGSNEWDNYRHQADVCHAYQLLKKGGLKDENIIVFMYDDIAYNKNNPRPGVIINSPHGHDVYKGVPKDYTGKDCNADNFFAVILGNKSALTGGSGKVVENGPNDYIFIYYADHGAPGLIGMPSGDDVYADDLIKVLIKKHTFGIYSKLVFYMEACESGSMFDGLLPKGLNIYVTTASKPDEGSWATYCISLGDEDVVCLGDLYSVAWLEDSDLHDRQVETLEKQYQLVRKRTLNNGTVEGSHVMQYGDLHISEDPLFRYMGSNSAKNSYYSTSTNDESWLPSRTVNQRDVHLMHLWSKFRSAPEGSARKTEAQRQLREAISQREHVDNSVRHIGEVLFGVEKGPEVLQTVRPAGQPLVDDWDCLKSFVKIFESQCGKLTPYGRKHVRGFANLCNAGIRREQMAAAAKQACPS

SEQ ID NO: 179 - protein, 359 aa, Artificial Sequence
  Description of Artificial Sequence: Synthetic polypeptide
MIRKNGVVPFLVALFVLVCTAEGRNLLESIVEDDNPTGTKWAVLVAGSNEWDNYRHQADVCHAYQLLKKGGLKDENIIVFMYDDIAYNKNNPRPGIIINSPHGHDVYKEYPSGKVVENGPNDYIFIYYADHGAPGLIGMPSGDVVYADDLNRVLIKKHTFGTYSKLVFYMEACESGSMFDGLLPKGLNIYVTAASKPDESSWATYCIRLGDEDQCLGDLYSVSWLEDSDLHDRQVETLEKQYQLVRKRTLNNGTEEGSHVMQYGDLHISEDPLFRIWVLILQKIVIILHNNDESWLPSRTVNQRDVHLMHLWSKVKIFESQCGTLTPYGRKHVRGFANLCNAGIRREQMAAAAKQACPP

SEQ ID NO: 180 - protein, 301 aa, Artificial Sequence
  Description of Artificial Sequence: Synthetic polypeptide
MIPARMADVCHAYQLLKDGGLKDENIIVFMYDDIANNRENPRPGVIINNPHGHDVYKGVPKDYVLEDVNANNFYNVILGNKSAVVGGSGKVVNSGPNDHIFIYYTDHGGPGVVSMPSGEDVYANDLIDMLKKKHASGTYDRLVFYLEACESGSMFDGLLPEGLDIYVMTASEPNEDSWATYCGEGTPDDPCLVECPPPEFQGVCLGDLYSVAWMEDSTIDRLLFLTPHDFYSFFSECLQHQNAPEGSDEKFKAHARLTEAISQRTQVDNNVKHLGELLFGVEKGNEILHSVRPAGQPLVDS

SEQ ID NO: 181 - protein, 483 aa, Artificial Sequence
  Description of Artificial Sequence: Synthetic polypeptide
MIVRYVVSAVLIIGLSILAAVEQGCAEITVGSIKVFSGEYDDDSIGTKWAVLVAGSRGCWNYRHQADVCHAYQLLKKGGLKDENIIVFMYDDIAHNPENPRPGVIINSPNGHDVYKGVPKDYTGHHVTANNVLAVILGNKSALSGGSGKVVESGPNDHIFIFYSDHGGPGVLGMPSGPYLYADDLIDALKRKHASGTYKRLVFYIEACESGSIFEGLLPEGLNICATTASNAEEDSWGTYCPGDYPGPPPEYQTCLGDLYAVSWMEDSEKHNLQRETLGMQYELVKRRTANSFPYASSHVMQYGDLKLMDDPLSLYMGTNPANDNYTFLDENSSLLSAKPVNQRDADLLHFWDKFLKAPQGSIRKIEAQKQLTEAMSHRMHIDDSIALVGKLLFGIEKGPEVLIRVRPTGEPLVDDWDCLKSFVRTFETHCGSLSQYGMKHMRAVANICNSGIKMEQIAKASAQACVSIPSNSWSSLDEGFSA

SEQ ID NO: 182 - protein, 157 aa, Artificial Sequence
  Description of Artificial Sequence: Synthetic polypeptide
MSYGDQSQTIGDLAFEKFTFPSIFGNNVNILDVVFGCGHDNSGTFNNYTSVIIGLGGGEVSIVNQLDKEINGKFSYCLITIPLQSSISNATSHINFDADLELSPSSTFAEVEEDLVSLTIVPAEEVAIFGNLEQANFLIGYDLVANKISSLPTDCTS

SEQ ID NO: 183 - protein, 288 aa, Artificial Sequence
  Description of Artificial Sequence: Synthetic polypeptide
MINSRHRRKYGSKDEWNMRFGIYQSNVQFIDFFNSLNLSYNLTDNAFADMTNLEFNSKYLGYKKRKHSKQLAAPNITCDSSKLPISVDWRKSGVVTRVKDQENCGSCWAFSAVAAVEGINKIKTGKLVSLSEQQLVDCDVFSDNQGCNGGFMEKAFAFINKNGGITTEKNYHYVGKDQKCNTTKAKQHAVTISGYEMVAKNEESLQAAFTKQPISVAIDASGYDFQLCAGGVYSVFFGNSLNHGVPLIGYGVDDGEKYWLVKNSWGTMWGEDGYIKIKRWSNDKKRNV

SEQ ID NO: 184 - protein, 706 aa, Artificial Sequence
  Description of Artificial Sequence: Synthetic polypeptide
MANSLLSSNFMGSQIFVSPPTPKTTKYFHFHSKRKSLIPQSILNKKPNSDNSKNIPSKAALAALLFSSITPHAYALDNTTPTVPTPQVIQAEAANPTTSNPFSQNIILNAPKPQAQTNPELPEVSQWRYSEFLNAVKKGKVERVRFSKDGTTLQLNAVDGRRASVIVPNDPDLIDILAMNGVDISVSEGDSGGNGLFNLIGSLFPFIAFAGLFYLFQRSQGGPGGPGGLGGPMDFGRSKSKFQEVPETGVSFADVAGADQAKLELQEVVDFLKNPDKYTALGAKIPKGCLLVDHLVQERHFWLEQLLVKLVYHFSMCSIRVVELFVGVGASRVRDLFEKAKSKAPCIVFIDEIDAVGRQRGAGMGGGNDEREQTINQLLTEMDGFSGNSGVIVLAATNRPDVLDSALLRPGRFDRQVTVDRPDVAGRIKILQVHSRGKALAKDVDFEKIARRTPGFTGADLQNLMNEAAILAARRELKEISKDEISDALERIIAGPEKKNAVVSEEKKKLVAYHEAGHALVGALMPEYDPVAKISIIPRGQAGGLTFFAPSEERLESGLYSRSYLENQMAVALGGRVAEEVIFGQDNVTTGASNDFMQVSRVARQMVERLGFSKKIGQVAIGGGGGNPFLGQQMSTQKDYSMATADVVDAEVRELVERAYERATQIITTHIDILHKLAQLLIEKETVDGEEFMSLFIDGKAELYIS

SEQ ID NO: 185 - protein, 745 aa, Artificial Sequence
  Description of Artificial Sequence: Synthetic polypeptide
MIIEVLILWHADVRHNISLTALSSTQSFYKDDLYIVFLKDHPVNEESLFQRHIIVLSSLKGSDGAATESHVYSYTKIFNAFAAKLSQHEVHMLSSMDEVVSVIPNRYRKLHTTRSWEFIGLPATAKRRLKRESNIIVGVFDTGITPQSKSFKDDGLGPPPVKWKGSCGHFANFSGCNNKLIGARYFKLDKVPDPNDILSPIDVHGHGTHTSSTLAGSMVPDASLFGLARGTARGAVPSARVAMYKVCWVTSGCADIDILAAFEAAISDGVDLISISIGGLSGSYTTDVIAIGSFHAMRKGILTVASAGNDGPNLNTVANHAPWMLTVAASGIDREFRSKVALGNGRIVSGIGVSAFDPKKKLYPLTAGVDMAKSSDTRDSSRYCGEGSMDPRKVKGKLVYCQLGTWGADSVIKELGGIGTIIESDQFLDSAPIFMALATIVNSSIGKNINNYMHSERLPSAVIYKSQEVKIKAPFIASFSSRGPNPGTIRLLKPDIAAPGIDILASYTPLKSLTGLKGDTQYSEFTLMSGTSMSCPHVGGAAAYVKSYHPDWSPSAIKSALVTTARPMSSKVDREAEFAYGAGQVNPTKARSPGLIYDMDDMSYIQFLCHEGYNSSSVSSLLRQRVNCSTLIPANGEDAINYPTMQLGLKSNQEPTIGIFRRKVTNVGQAISVYNATIRAPKGVDITVKPTTLSFTRAMQTRSFKVVVKAKPMSNAVILSGSLIWKSSRHLVRSPIVIYDPKVFD

SEQ ID NO: 186 - DNA, 2372 bp, Artificial Sequence
  Description of Artificial Sequence: Synthetic polynucleotide
atggattccttaccagtctcctccattgaatctctagtcattgagatcaagaaagagatgttctcaaaccaagaatttaacacttttgtcaccccaatatctgcctatgacactgcttggttggccatgatttcttataataatcaagaagaagccattaatggtcattctttttctggccctatgtttaagagttgtttaaattggattctcaacaaccaaaatgagcaaggattttggggagaatccaatggtgtttgaaatttattcatgctaatacggaaatacttctgaaagagaattctcaacaatttccacgttggttcatcattgttttccctgcaatggttcaactttctaaatcagtaggcctggagattatttttgtgaatggatcagaaagattactttcggacgttgcaatgaaaaggaaagtaattcttgaaagtgaaaagctaatggacgtgacagcagggcatgatcaacctctattggcatatttagagagcttgccaaattatgttttgaatcaaaaagaccaaatcctaaaacatttaagtgaagatggttctttgtttcaatctccctctgctacagcacaagcattcatggccacaggaaaccaaaaatctcttgaatatctcatgtccattgttcataagtgtccaaatggagtgcagtaccttcaatgtttccagtggatgaagagctaacaaagctttgcatagttgaccacattcaaagaatggattgtttatctgagagattatacaaggactcattggcttttcgacttctccgtttgcaaggctataaaataaatgaagggaagtttttgttggtttgttcatcaaccgcagataagggcctacatagaaaagaatcaagaacgttttacgtatgtgatgtacaatgtgtacagagctacagatctcatgtttaaaggagaatctgaaatggaggaagtacgatcttttgccagatattttcttgaacgttcaatgaagctcgtgaacaatgagggcagcttattacttcttcctacacttcaaaaagtgattaagcatgagttgaatgttccatgggttgctcgactagaacatcttgatcacagattatggattgaattaagtcaatctctccctctttcaattggaaaatccgcagattattggttgtcttgtctgcacaatgacaaattgctgaaattagcagtgcaaaattacgaatttcggcagtcagtttacaggacggaattggaagaactaaagagagttggtcgaaagagaaaggccttgtggacattggatttgggcgagagaaaactacatattcctattttgcaagtgcagctagcagcagcagttttctaccttttgattcttattatgatgaggaagcttctttaagtgacttgcaaatcttaaccgacgctgtacaaaggttacataggtgggatggaagtaaccttgatggccctagtaagatcatatttgatgcacttgatgatcttgtgtgtgatgttgctaagttataccaccttcgacacgcaattgacatcaccccagaacttcgacatgtggcaggagacatttcttgcatggatgatggaaagtacgtggagtaataatgtagccatgccatctaggaatcaatacctagaaattggcatgatatcaatcggtgcacatattttggttcttcacgctgcttctcttgaaaatccaagcttgccaagggaaaaacttaggccaattaatggccaatatgaaaatattacaaagttgctaatggccaccactcgtttgttgaatgacatccagagctatcaacagaaagaatgtgaagtagggaaaatgaactacacattacttcacatgaatgaaaatccaggggcacaacttgatggttcaattgaatttgtgaaagagattttggccaacaagaagaaagaatttcttgaaaatgttctaatggatggattcaatgatatgccaaagaaatgcaaacttcttcatctttcttgcctaaatgtatttcacatgttcttcaattcttgcaatttatttgataccaaagcagcaattcttgaagatataatgagagctatttacgttcctcttcaagaacaaacctcagttccacctttaaaaacttctccaattttaacacctcaagaaaagaagaagaagaagaagaagaagattgagaatattccaactaaagtttctgcttgtctcaatgggaaaaacttcaaacaccaagttggcattggcataagttttgttggaagtaaagctcctaagaataatccttttggttggtatacaaaaggatttgcttcacaaaagttaagttcatgtttcatatga

SEQ ID NO: 187 - protein, 86 aa, Artificial Sequence
  Description of Artificial Sequence: Synthetic polypeptide
MDSLPVSSIESLVIEIKKEMFSNQEFNTFVTPISAYDTAWLAMISYNNQEEAINGHSFSGPMFKSCLNWILNNQNEQGFWGESNGV

SEQ ID NO: 188 - DNA, 1029 bp, Artificial Sequence
  Description of Artificial Sequence: Synthetic polynucleotide
atgggggggggtggttctagtggaaatacttcttcatgtttaatgggttatggagatgacaacaacaacaataacagtggaaatgcagccctatgtcctcctcctatgatgatgcctcctcctcctattaataataacaatggagaaagcagcaataatattggtggcaacaacaacaacaatatcctgtttctcccttttatggccaacaacaacaataatccacatgaagacgcaaactgttcttcttctagttccatcaagtctaagattatggctcatcctcactaccctcgtctcttgtctgcttatgtcaattgtcaaaagataggagctccgccggaagtggtggcaaggctagaggaagtatgtgccacgtcagcaacaataggccgtaacagtggcggcattatcggagaagatccagcgctagatcagttcatggaagcttactgtgaaatgctgacaaaatatgagcaagaactttcaaaaccctttaaggaagccatggttttcctctcaagaattgagtgccagtttaaagctctcactcttacttcctcctctgaatctgttgcagctctaggtgaggcaatcgatagaaatggatcgtctgaagaggaggttgatgtgaataacggtttcatcgaccctcaggctgaagatcaagaactgaaaggtcaattgctgcgcaaatacagtggttacttgggtagccttaagcaggagttcatgaagaagaggaagaaaggcaagctgcctaaggaagcaaggcaacaactactggactggtggaccagacattacaaatggccatatccatcggaatcccagaagctggcactggctgaatctacaggattggaccaaaaacaaataaacaactggtttatcaaccaaaggaaaaggcactggaaaccttcagaggatatgcagtttgtggtaatggatgctgctcatccacattactatatggacaatgttctcggtaatccttttccaatggatattacaccaactctcctctaa

SEQ ID NO: 189 - protein, 342 aa, Artificial Sequence
  Description of Artificial Sequence: Synthetic polypeptide
MGGGGSSGNTSSCLMGYGDDNNNNNSGNAALCPPPMMMPPPPINNNNGESSNNIGGNNNNNILFLPFMANNNNNPHEDANCSSSSSIKSKIMAHPHYPRLLSAYVNCQKIGAPPEVVARLEEVCATSATIGRNSGGIIGEDPALDQFMEAYCEMLTKYEQELSKPFKEAMVFLSRIECQFKALTLTSSSESVAALGEAIDRNGSSEEEVDVNNGFIDPQAEDQELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYMDNVLGNPFPMDITPTLL

SEQ ID NO: 190 - DNA, 738 bp, Artificial Sequence
  Description of Artificial Sequence: Synthetic polynucleotide
atgtataccccagacactccggcgcaagaactatatgacgaggaatattacgacgagcagtcgccggagaagaagcgccgtctcactcccgagcaggtgcacttgctggagaagagctttgaggcggagaacaagctggagccagagcgtaagactcagctagccaagaagcttggcctgcagcccaggcaagtggctgtgtggttccaaaaccgccgcgcccggtggaagaccaagacgctcgaaagggattatgatcagctcaaatcctcttatgactctcttctctctgattttgactccattcgcaaagataatgagaagctcaaagctgaggtggtttcattgatggagaagttgcaggggaaagtggttggtgaagcaggggtaataaatgaaaaatgtgaggttttggaggtagatgcgctgacccttcaagtgaaggtgaaggcggaggacaggctgagcagtggcagcggcggaagtgcggtggtagatgagcacagtccacagctggtggacagtggggactcctattttcacactggtcatatggaagagtatccactaggggctggaggatgtaataatattcctccgcctatggatggtttgcagtcggaggaagatgatggtagtgatgacggcggcggccatggctacttctgtaacgtctttgtggcggcagaggagcagcaacatgaagaaggagagcctattgggtggttctggtcttga

SEQ ID NO: 191 - protein, 245 aa, Artificial Sequence
  Description of Artificial Sequence: Synthetic polypeptide
MYTPDTPAQELYDEEYYDEQSPEKKRRLTPEQVHLLEKSFEAENKLEPERKTQLAKKLGLQPRQVAVWFQNRRARWKTKTLERDYDQLKSSYDSLLSDFDSIRKDNEKLKAEVVSLMEKLQGKVVGEAGVINEKCEVLEVDALTLQVKVKAEDRLSSGSGGSAVVDEHSPQLVDSGDSYFHTGHMEEYPLGAGGCNNIPPPMDGLQSEEDDGSDDGGGHGYFCNVFVAAEEQQHEEGEPIGWFWS

SEQ ID NO: 192 - DNA, 1641 bp, Artificial Sequence
  Description of Artificial Sequence: Synthetic polynucleotide
acacattaaactaaagaagagagaactttagaggttagagagatgaagacgcaacatcaatggtgggaagttcttgatccattcttgacacaacacgaagctcttattgcattcttgacttttgcagcggttgtaattgtgatttacttgtaccgaccctcctggtccgtatgcaatgttcccggtccaaccgctatgcctctagttggtcacttgcccttgatggctaagtatggtcctgatgtcttctccgttcttgctaagcaatatggccctattttcagatttcagatggggaggcaaccactgataataatagcagaagcagagctttgcagagaagttgggataaagaagttcaaagatcttccaaacagaagcattccttccccaatctcagcttctcctcttcacaagaaaggcctcttcttcaccagggacaagagatggtctaaaatgagaaacaccatcctatctctctatcagccttcacatttaacaagtcttatccctacaatgcatagtttcatcacttctgctactcataatcttgattctaaaccgcgagatatcgttttctccaacctcttcctcaaacttaccactgatatcatcggacaagcggcttttggagtcgacttcggtctttccgggaagaaaccaatcaaagatgtggaggtgactgatttcataaaccagcatgtctactctacaacacaactcaagatggatttatcaggatcactctctatcatcttaggcttactgattccgattcttcaagagccgtttaggcaggtgttgaagaggataccgggaacaatggactggagagtcgagaagactaatgcaagactgagtggacaacttaatgagattgtgtcaaagcgagccaaggaggctgagactgactcaaaagacttcttgtcattgattttgaaagctcgagagtccgatcctttcgccaaaaacatcttcacatcggattatattagtgctgtgacttatgagcatcttcttcttgatgttgagaaacgtctgcttcaagaaattgacgggtttgggaaccgtgatctgatcccgactgctcatgacttacaacacaagtttccatacctcgatcaggtcattaaagaggctatgagattctacatggtttctcctttggttgcaagggaaactgctaaagaagtggagataggaggttatttactcccaaaggggacatgggtttggttagcactaggagttctagcaaaggaccctaaaaactttccagaaccggagaagttcaagccggaaagatttgatccgaacggagaagaggagaaacatagacatccatacgctttcatcccattcggtatcggtccacgagcctgtgttggacagagatttgccctgcaagagatcaaactcacattactgcatctctaccgtaattacattttcagacattccctagaaatggagataccactgcagcttgattatggtataattctcagcttcaagaacggggttaagctcagaaccatcaaaagattctgattcttgaaacaagtgaaataaaagcaagactgaaatttatatttaaattcaaaactccaatgtagttccaaaggaaaaagaacaattaac

SEQ ID NO: 193 - protein, 522 aa, Artificial Sequence
  Description of Artificial Sequence: Synthetic polypeptide
MKTQHQWWEVLDPFLTQHEALIAFLTFAAVVIVIYLYRPSWSVCNVPGPTAMPLVGHLPLMAKYGPDVFSVLAKQYGPIFRFQMGRQPLIIIAEAELCREVGIKKFKDLPNRSIPSPISASPLHKKGLFFTRDKRWSKMRNTILSLYQPSHLTSLIPTMHSFITSATHNLDSKPRDIVFSNLFLKLTTDIIGQAAFGVDFGLSGKKPIKDVEVTDFINQHVYSTTQLKMDLSGSLSIILGLLIPILQEPFRQVLKRIPGTMDWRVEKTNARLSGQLNEIVSKRAKEAETDSKDFLSLILKARESDPFAKNIFTSDYISAVTYEHLLAGSATTAFTLSSVLYLVSGHLDVEKRLLQEIDGFGNRDLIPTAHDLQHKFPYLDQVIKEAMRFYMVSPLVARETAKEVEIGGYLLPKGTWVWLALGVLAKDPKNFPEPEKFKPERFDPNGEEEKHRHPYAFIPFGIGPRACVGQRFALQEIKLTLLHLYRNYIFRHSLEMEIPLQLDYGIILSFKNGVKLRTIKRF

SEQ ID NO: 194 - DNA, 2329 bp, Artificial Sequence
  Description of Artificial Sequence: Synthetic polynucleotide
atctcctctcttgtagatttgccgcttctcatggcttccactactctctccgacctccctgacgtcatcttatccaccatttcctctctcgtatccgattcccgagctcgcaactctctctccctcgtctctcacaaattcctcgctctcgaacgatccactcgctctcacctcactatccgtggcaacgctcgtgatctctccctcgtccccgactgtttccgatcaatctcacatctcgatctctctttcctctccccatggggtcacactcttctcgcttctctcccaatcgatcaccagaaccttctcgctctccgtctcaaattctgtttccctttcgtcgagtctctaaacgtctacacacgatctccgagctctctcgagcttctacttcctcaatggccgagaattcgccacatcaagctcctccgatggcatcaacgagcttctcagatccctaccggtggcgattttgttcctatttttgaacactgtggtggtttccttgagtctttagatctctccaacttctatcactggactgaagacttacctcctgtgcttctccgctatgctgacgtggcggcgaggcttacacggttagatctcttgacggcgtcgttcaccgagggatacaaatcaagcgaaatcgttagtatcaccaaatcttgccctaatttgaagacttttcgtgtagcttgtacgtttgatccgagatactttgaattcgtcggagacgagactctctccgccgtagctaccagttcccctaagttaacgcttctacacatggtggacacagcttcgttggcgaatcctagagctattccaggtacggaagctggagattcagctgtcacggcggggacgctaattgaagttttctcaggtttaccgaatctagaggagctggttcttgacgtaggaaaggatgtgaagcatagtggtgtagctttagaggcattgaattctaaatgcaagaagttaagagtattgaagctaggacagttccaaggtgtttgctctgctacagaatggaggaggctcgacggtgtggctttatgtggaggattgcagtcgttgtcgattaagaattccggcgatttgactgatatgggtttggtggctatagggagaggatgttgtaagttgactacgtttgagattcaagggtgtgagaatgtaacagtggatggactaagaacaatggttagtcttcggagtaagactttgactgatgtgagaatctcttgctgcaagaatcttgacacagctgcttctttaaaggcaattgagccgatttgtgatcggatcaagagactgcatatagactgtgtgtggtctggttcagaggacgaggaggtagaaggaagagtggaaactagtgaggctgaccacgaagaggaggatgatggttacgagaggagccagaagaggtgcaagtattcattcgaggaagaacactgctcaactagtgatgtgaatggattctgttctgaagatagagtatgggagaaactggagtatctatctttatggatcaatgttggagaatttttgacgccattacctatgacaggactagatgactgtccgaatttggaagagattaggatcaagatagaaggagattgcagaggtaaacgcaggccagccgagccagagtttgggttaagttgtctcgctctctacccaaagctctcaaagatgcagttagattgcggggacacaatcggtttcgcactgaccgcaccgccaatgcagatggatttgagtttatgggaaagattcttcttgaccggaattggaagcttgagcttgagcgagcttgattattggccaccacaggatagagatgttaaccagaggagtctctcgcttcctggagcaggtctgttacaagagtgcctgactttgaggaagctgttcatccatggaacagctcatgagcatttcatgaactttttgttgagaatcccaaacttaagggatgtacagcttagagcagactattatccggcgccggagaacgatatgagcacagagatgagagttggttcgtgtagccgattcgaggaccaattgaacagccgcaacatcattgactgaaacttgaagagtgagttacctacactattatatctgtattgacttcagaaactggtccattttatttgtatggtcaagagtgttttgtatatgtttgtaagaggaaaggacaaagactataatttgcgatgattaatgatatcataaaacaataatccatttttataaatgataaaactcaaatgaagaagccggagagatctggagtacaaactca

SEQ ID NO: 195 - protein, 693 aa, Artificial Sequence
  Description of Artificial Sequence: Synthetic polypeptide
MASTTLSDLPDVILSTISSLVSDSRARNSLSLVSHKFLALERSTRSHLTIRGNARDLSLVPDCFRSISHLDLSFLSPWGHTLLASLPIDHQNLLALRLKFCFPFVESLNVYTRSPSSLELLLPQWPRIRHIKLLRWHQRASQIPTGGDFVPIFEHCGGFLESLDLSNFYHWTEDLPPVLLRYADVAARLTRLDLLTASFTEGYKSSEIVSITKSCPNLKTFRVACTFDPRYFEFVGDETLSAVATSSPKLTLLHMVDTASLANPRAIPGTEAGDSAVTAGTLIEVFSGLPNLEELVLDVGKDVKHSGVALEALNSKCKKLRVLKLGQFQGVCSATEWRRLDGVALCGGLQSLSIKNSGDLTDMGLVAIGRGCCKLTTFEIQGCENVTVDGLRTMVSLRSKTLTDVRISCCKNLDTAASLKAIEPICDRIKRLHIDCVWSGSEDEEVEGRVETSEADHEEEDDGYERSQKRCKYSFEEEHCSTSDVNGFCSEDRVWEKLEYLSLWINVGEFLTPLPMTGLDDCPNLEEIRIKIEGDCRGKRRPAEPEFGLSCLALYPKLSKMQLDCGDTIGFALTAPPMQMDLSLWERFFLTGIGSLSLSELDYWPPQDRDVNQRSLSLPGAGLLQECLTLRKLFIHGTAHEHFMNFLLRIPNLRDVQLRADYYPAPENDMSTEMRVGSCSRFEDQLNSRNIID

SEQ ID NO: 196 - DNA, 1110 bp, Artificial Sequence
  Description of Artificial Sequence: Synthetic polynucleotide
atgggcagacagccactagttatagtagcagatgcagagctatgcagagaagttggaataaagaaattcaaggacataccaaatagaagcatcccatctcccattgcagcatcccctcttcatcagaaaggcctattttttactagggactccagatggtcaacaatgagaaacactattctatcagtctaccagccatcttaccttgttaagttagtgccaatcatgcaatcgtttatcgagtcttcaactaaaaatcttgattctgagggagatctcacattctctgatctctccctcaagttagctactgatgtaattggacaagctgcttttgaaagaacaaacaagaatttaagcaggaggttagatgagatagtggcaaagaggatggaggaaaaagatcgcagttcaaaggacttcttatcgcttatactgcaggcaagggagtcagagaagttagctaagaatgttttcacctcagattatatcagtgctgtaacttatgagcacttactggctggttctgcaacaacttcctttacattgtcttctattatctatttggttgctggccatccagaggttgagcagaagttgctcacggagatagatgcttttgggcctaatgatcacatactcactgccattgagcttcagcagaaattcccataccttgatcaggtaatcaaagaagcaatgaggtgttatgtcgtctcacccttagttgccagagaaacatcagctgaggtggagatcggaggctataaacttcctaagggcacatgggtttggttggctcttggagttcttgctaaggattcaaagaacttccccgaaccagagaagtttagaccagagaggtttgatccaagctgtgaagaggaaaaacaaaggcatccttatgcaaatattccatttggaatagggccgcgagcatgcataggacagaagttctccatacaagaacttaaactctcactgattcacttatatcgcaagtacatttttcgacactctccccttatggaaaagccactggaacttgagtatggtatagtacttaactataagcatggagtcaaggtttgtgccatcaagcgtaaatga

SEQ ID NO: 197 - protein, 369 aa, Artificial Sequence
  Description of Artificial Sequence: Synthetic polypeptide
MGRQPLVIVADAELCREVGIKKFKDIPNRSIPSPIAASPLHQKGLFFTRDSRWSTMRNTILSVYQPSYLVKLVPIMQSFIESSTKNLDSEGDLTFSDLSLKLATDVIGQAAFERTNKNLSRRLDEIVAKRMEEKDRSSKDFLSLILQARESEKLAKNVFTSDYISAVTYEHLLAGSATTSFTLSSIIYLVAGHPEVEQKLLTEIDAFGPNDHILTAIELQQKFPYLDQVIKEAMRCYVVSPLVARETSAEVEIGGYKLPKGTWVWLALGVLAKDSKNFPEPEKFRPERFDPSCEEEKQRHPYANIPFGIGPRACIGQKFSIQELKLSLIHLYRKYIFRHSPLMEKPLELEYGIVLNYKHGVKVCAIKRK

SEQ ID NO: 198 - DNA, 2175 bp, Artificial Sequence
  Description of Artificial Sequence: Synthetic polynucleotide
atggctacagctacacaacttacttgttctaccattattaacgacctacctgatgtgatcctttctaacatcatcgccgcaatctccgacgtccgcagccgcaactccgccgccctcgtctgccggaaatgcctcgtcctcgaacgttccacgcgcgtctccctcacgctccgtggcaacgtccgtgacctcttcatgttacccacttgcttcagatccgtaactcaccttgacctctcccttatctctccttggggtcacccactcctctctccggtcgacggcgccggcgcagaagctgacccttccctcatcgcccaccttctccgccacgcgtttccttccgtcacttccctcgttgtctacacgcgccacccattcaccctccagcttttgcctcctctatggccccacctaaaggaaatcaagcttgtgcggtggcaccagcgtccccaattagctactggtgatgaatttaatatgctatttgagaattgcccacagcttaaatctctagatttgtcgactttttactgctggacggatgatattcctacagcacttgaatctcatcctatggttgcttctaatctcactagctttaatctcttgaattccagttttcctgaagggtttaagtctgatgagattaaggtaattacacaagcttgtcctaatttgaaagagtttaaggttgcttgtatgtttgatcctaggtacattggttttgttggtgatgaaggtttggtttctatagctacaaactgtaccaaattatcagtgcttcatttggcggacacatcagctttgtccaactctaggggtgatccaaatgatgaggggttcaccgaagaggatgcgaagattagtgttggaactttgattgaggtattttctggtcttccattacttgaagagcttgttttagatgtttgtaataatgttagagacacgggtcctgccttggagattttgaatagaaaatgtcccaaattgagatcgttgaagttggggcaattccacggtatttctgtgccaattgaatcgaagttggatggggttgctctttgtcaagggcttcaatctctgtcgataagtaatgtgggggacttgaatgatatgggtttgatagctattggtagagggtgttcgaggttagccaagtttgagattcgaggttgtaagaagataactatgaggggaatgaggacactagcttctttgcttagcagaactttggttgatgtcaagatatcttgctgcaagaatcttggagcctcttcttcattgaaagcattggaaccgatacaaagacggatacaaaagcttcacattgactgtgtgtgggacagcgttgaagaatttgagaatcttgatggtaatggatacgggtttgatcttaacaggaatgatggaggggaggcatcaagcaactttgcttgttccggggacacatttggatgcgaggaagatgcttacatgtttagacagaagaaaagatgcaagttctcctatgatattaatagtttgtatgaggatgtcaatggccatggcaatggatatagtggacgatcatgggataagctgcaatgcctctctctttggattggtgttggtgagcttttgactcctttaacaactgcaggtcttgaagactgtcctaacttagaggagatcaagattagggtggaaggagattgcaggctttggtcaaaaccttcggagcgggcatttggactgagcaccctactactctatcctaagctttccaagatgcatttggattgtggagataccataggttatgcacacactgcgccatcagggcagatggatttgagcttgtgggagaggttttatctgtttgggattggaaatttgagccttgccgaactagattactggccacctcaagatagggacgttaaccaaaggtgtctatccctaccagcagctgggctgctacaagaatgcatcacactcagaaaactgttcatccatggaacagcgcatgaacatttcatgatgttccttcttagaatcccaaacataagagatgtacaactgagagaggattactatccagcaccagagaatgacatgagtacagagatgagagcagactccttgagccgctttgaagctgccctaaacaggcgcccaatatccgattga

SEQ ID NO: 199 - protein, 724 aa, Artificial Sequence
  Description of Artificial Sequence: Synthetic polypeptide
MATATQLTCSTIINDLPDVILSNIIAAISDVRSRNSAALVCRKCLVLERSTRVSLTLRGNVRDLFMLPTCFRSVTHLDLSLISPWGHPLLSPVDGAGAEADPSLIAHLLRHAFPSVTSLVVYTRHPFTLQLLPPLWPHLKEIKLVRWHQRPQLATGDEFNMLFENCPQLKSLDLSTFYCWTDDIPTALESHPMVASNLTSFNLLNSSFPEGFKSDEIKVITQACPNLKEFKVACMFDPRYIGFVGDEGLVSIATNCTKLSVLHLADTSALSNSRGDPNDEGFTEEDAKISVGTLIEVFSGLPLLEELVLDVCNNVRDTGPALEILNRKCPKLRSLKLGQFHGISVPIESKLDGVALCQGLQSLSISNVGDLNDMGLIAIGRGCSRLAKFEIRGCKKITMRGMRTLASLLSRTLVDVKISCCKNLGASSSLKALEPIQRRIQKLHIDCVWDSVEEFENLDGNGYGFDLNRNDGGEASSNFACSGDTFGCEEDAYMFRQKKRCKFSYDINSLYEDVNGHGNGYSGRSWDKLQCLSLWIGVGELLTPLTTAGLEDCPNLEEIKIRVEGDCRLWSKPSERAFGLSTLLLYPKLSKMHLDCGDTIGYAHTAPSGQMDLSLWERFYLFGIGNLSLAELDYWPPQDRDVNQRCLSLPAAGLLQECITLRKLFIHGTAHEHFMMFLLRIPNIRDVQLREDYYPAPENDMSTEMRADSLSRFEAALNRRPISD

SEQ ID NO: 200 - DNA, 1338 bp, Artificial Sequence
  Description of Artificial Sequence: Synthetic polynucleotide
atgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatga

SEQ ID NO: 201 - protein, 445 aa, Artificial Sequence
  Description of Artificial Sequence: Synthetic polypeptide
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 202 - DNA, 990 bp, Artificial Sequence
  Description of Artificial Sequence: Synthetic polynucleotide
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 203 - protein, 329 aa, Artificial Sequence
  Description of Artificial Sequence: Synthetic polypeptide
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 204 - DNA, 5000 bp, Artificial Sequence
  Description of Artificial Sequence: Synthetic polynucleotide
aagctagcaccatagatagtgggtgtcaccattttacagcaaataatatgcctcaattggtggagaaagggtctttaaagttgaagtgtttttctttttttctctttctttttcttggtaggtggtggggaaggggaaaatgaggggacaaaacacgaaaaatcaattttgatgtataatttacacaagactcaagctaagtgatagagttgataaaaggataacaataatatgggacacataaattcatgacgtctccgtttatcggatattttctcaaattgatgtaacatatgtttcaagaagttcaaataatgtgtatatagatttatttctataaaatattatttcgaattataaatcttcgactcaagaaaaaataaaaatgttagatatggcaaaggggatagcacttagacaattaggcaacctcatatttgttacaagtgggggtgagggttcaactttgcattatttagcatcactttgttatttattttttttatataaaatttatagaacaggagatgttaatataaggatgacaatccagattgacaaagttgtgatagtgatactactgtaacatcttattcaatcatgcaaagcatctcccattaatttgtccatcttttcgaatattacgaaaatcagacctactttttttacatataattttctctaatgacatcacaggaactactcctgagagaaatattctcactcaagtttgaaaacgactcttaaattatgataaagtgataactacaatgaccggctaactcttgcgtgcattatgagtgtatatagttatatgttatttactctcgtcgtaaatatcaagtgcgaataatatgtatgaaatttagagaaatgagagtaaattagtcgatgtttttaatttacgttgtgatttattcgttactttttgctttctctaaagtcaatttcagtagttcgtggagatacattagattaaattaatctaatctgttaaatactacacggtaaaaaataaaaaatatttaaaacgacataaaattttattatcaaaataagtaaatcacaaattgggggggggtttggctttttttttttttgtccgaaaattattatcatcggtatatataactatgcttcttatattatatttttttagtgaaaattctaattttcgtaggcatacatttaattaagataagtaaatatgatgaataagaacagattgataaacgtgatttaagaaaaataaagaaaggagaaatgaatagtagttccaatttataaaaaaaagtcaagtacttaggagttaaggttcgtgagtagatgggacatatcacggtggaaaaggtagaagaagcttcaaagatacaaaagaaaaagaggggttgagattctgtgttgtgattaatacaattcaatcaaagaaaaagatgtgtcattttggacatacaactctccctaaaataaaatgccaataaacacagtacttgtggacatcatccacccatccttttatgactcatcacacaaaaaaaacacttttttccttcttatttttgaagatattctatgaagtttgttgtaaacttaaacaaaataaatcaacaaaattgtcctatctctaaatagaggagtttttaaaagttaaaaatcaatagaatagatacatgaagtagtcgaaggagatttgacattttattatgtatatatataaaattattttaatcatatataaaaaatataattttctatcaaaaagtgaatcctttcatatttgtatctccgccctatctccaaatattaagctcacacatgaaaagagcgagagacgaatgtagcctattggctatgggttccctcactttcgatatgatgtgtataaaaaaattaattgaaatctcaataaatattagattttaacaataagttaaaaattcaaatcattaagtggggtcttgatttattttcttttgttttctttctcaaactgatgtttttattaaggatttattagaaaaatatttctatctctcggggtaggaattaaatttgctatgtgtatatcctaccttttgttaaatttagtttacagaattatcggttaaatatgttagatatgttattattgttgttacgtccgaatagacacccataggtgtagtgtagtcaaattaataaaaccatggaatacgatgggatatcaaagttgataatttttaactaaaaaaaaatgtcactagatgatttttttttctctcaattgtctaatcttgacagaaagatgtacctaatgaaataataaaagtgcaacaaaaaagaatagacaaatttccaaaaattgaatcttttgttggtactcgtcaacaagttattcttcatgtctaaatcctaaaaaaaatatctcctcgtgtaaagactggtatattgaaaatttaaaataaattaatacatctaaacgtatcatatcttctatataatataaaatttttagtgactcgtttcttacaattcaataatttagtataaataatttgtcgattgcgcggatgaaagaaaggggtggtggtggagatataaagtgtgatcgatagggtatcttgtatgtgattaatatagctaaacaaaaaggtgaaaggcaaaaacatatatgaatggtggtcctattccatatttaaatggattattaggatacgtcgatttcactttgcaaaataccctctatagattcatatattttcttttctcatcaacttttttttctatcatataactagccttactctggcttctcacgtttcacatgtctcaatgtttatttgttttttttccactcttgggcgtctaaagggtttagaaaaatttgacaatgtggaccacccaaagtttataaaattagaattaaacagtcatgaaggcatatacctaggagttccatttacatcttcacgtataaaatgtgtactttatattaattttatttatctcatgattcttattagagatgataaatgtaacattttttttttgtttttattaaattttagaagagataaccttcttgattaattctatgattttccttttttattacgaaactgaaacttaacaattaactgagacataacaaacatgaatgtagttcatatctaaattaacatcaaagccatcatatctaactcaactaagttagtcatggtactcttgtgattgacataaattttacaataaactttcttagctagaacggactcaccaacaaatataaaaccacagaaaaaattatatcgaactcaatactaaacaaagaagtatggaagactaaatatgttgatacgaggtaggcttattggtgattttacaagggcttatatagcaaaagttgatacaaacaaatgggctaaaaagtaaatggcccatttattttatttattttttccattatcaatacacagatttgcacttcgttagcggacaattttgggtaaattatgaaaattgggcctcttcacaatttagatcccgaccgtgtggatggatggacaaggaaattttaggtccagttccagttatattggggagataaaaggaaaaattacgtggttaagtaatatatatattagttaattagttattataataattattttagttaattattattcgcgattaacattagtgataattatgtaggctgagattttgagtttgtataatttgaaattttaagatataatttctataacttttatatagtacaattttataaaatattatttgtataattgataaaatttagatgtttgtgtttgtataaatttatattttagatttatcaaaatataactcaattattcaaactaaccataatacgtacgaattcactcacaaattatacaaacaatacaatttgaaccatagctgcaacccctaataatgcgagctacgactataaagtataattaaatttatttactataacggatatttgcaaaaattctccttaggcataaccaataatggcccctgaacgagttgctcgaaaaagctaattaaagatcattcatttttggaaaactatataaatcagaagactaaaatatagcttttagcttttcacttgaaataagttattttttatttaaataaattattttgataattattaaacactctaataaattaaaaagatgatttttaagtcagattgatcagcttttaagtccatctaaagatgctttaattacatcttattttttaaaaaaaattaattattaaaatttcaaagttttcattgctctcgaagacatttttttaaatgtccggtacattgtaataatatattatttaatggaaggaaagtatagaaggattttttaaaaaaaataattaagtgataaacttttttagaaattataatatgttgtatatttacgttaaatttcttaattttttaatttaacatttcccaaaaattttgtgttatccaaatgtccgaataacaaccaattaactgacactgaatttgtgaattttacgagacaaatgttcttgttaaaatttcatattaggtttcaactgtgagttatttttggaaatttaaattatgtgtgttgatcaaaatactttaaatatttttttttcattatatcatgaattttaaatagatatcatatatttttaaaagatttagatttaaattttactattaatatactaaaccgacatagccttaagttgaaaaaatatcaaattcatcgagggaaaacgaaaattgcaagtatatttggccaaacgaagcacctgtccatgaaatgccacgtaaaaattctaagcaaaaatactacaataagtgcatggaatgagacgagcacgtgtcaagttgaaagaagcacctgtccatgaaatgccacgtaactcacaccttcaaaacctctccattgctacaaatctccatatttttgttttttttttttaagaaaaagataaaagtactagca

SEQ ID NO: 205 - DNA, 2058 bp, Artificial Sequence
  Description of Artificial Sequence: Synthetic polynucleotide
atgtcggtgaaaaattgtatgtcgattcaatgttgcaaaatcttgttcaagtttctactgtttatgattattatcatcagtagcgtgtttatcgatgtaagagctaaaagagaaaatgaaggttgggaatggggtttaggtcctctgattaaaagagcagaaagaaaaacagttatttcaactgaaaatggtgaagtctcatcagtcacagtagctgatggaacaacctatcatcttcaattcatcacattggaacccaactccctcttccttcccgttgttctacatacagatatggttttttatgttcacactgggtcggggaagctaacttggatgaatgaaaatgaagagaaatcagtggatttaagaataggagatgtattcaggctgccttttggatctattttcttcttagagagtgacttagaccctatcagacacaaacttagactttattccatttttcccaattcaggccgagaatcactgagtgagccctactccagcatccgtaaaatggttcttggattcgacaagaaagtcctccaagcggcatttcatgtaccagaggatgtgatagaagaagtgttggctggaacagaagtaccagccatagtgcacggtgtgccaaagtcaactaagaagaagaagaacttatgggagatggaggctcagttcatgaagactgttttaggaaggggtagttatagtttctttgacaaccgaaggaataaaaagaagagttctcaattgttcaatgtattccaagagaaaccagattttgagaattgcaacgggtggagcacggtaataaacaggaagaaattgccggcgttaaagggctcgcaaattggtatttacgtagtgaacttaacgaaaggatcaatgatggggccacattggaatccaatggctactgaaattggaatagcaattcaaggagaaggaatggtgagggtagtttgctcaaagagtggaacagggtgtaaaaacatgaggtttaaagtggaagaaggggatgtatttgttgtgccaaggtttgatcctatggctcaaatggcattcaataacaattcatttgtgtttgtggggtttagcacaactacaaagaaacatcatcctcagtacttaacggggaaggcatcggtcctccgaacattggataggcagatattggaagcatctttcaatgtgggcaacacaacaatgcatcagattcttgaagcacagggtgattcagttatactggagtgtacatcttgtgctgaggaagagaagaggttgatggaggaagaaatgaggaaggaggaggaggaagcgaagaagaaagaggaggcaagaaaggctgaagaagagagaagagagaaagaagcagaggaagaaaggaagagacaagaggaagaagcaaggaaaagggaggaagaggaaataaggaggagacaggaagaagaggaagctaggagaagacaagaggaagaggaagaggaaagagagagacaggaagctagaaagaaacaagaagaggaagaagcagcacaaagagaggcagagcaagcaaggagagaagaggaagaagcagaaaaaagaaggcaggaggaggaagaatcaaggagagaggagaaagcaagaagaaggcaacaggaggaagcaaggaggagagaggaggaagaagcagcaaaaaggcaacatgaggaagaagcagagagagaggcagaggaagcaagaaggatagaggaggaagaagcacaaagagaggcagaagaagcaaggagaatacaacaggaggaagaagcagagagagcaaggagaagagaagaagaagcagaaacaagaaggaaggaggaggaggaggaagaatcaaggagacaagaggaggaatcaaggaggagtgaagaagaggcagcaagagaggcagagagggaaaggcaagaggaagctgaaagacaagaagaagctaggagacgggaggaagaaacagaagagaggcatcaacaagaagaaaccgaggaagaggagccaggccaacctgaaatgaacggatattcctcaaactag

SEQ ID NO: 206 - protein, 685 aa, Artificial Sequence
  Description of Artificial Sequence: Synthetic polypeptide
MSVKNCMSIQCCKILFKFLLFMIIIISSVFIDVRAKRENEGWEWGLGPLIKRAERKTVISTENGEVSSVTVADGTTYHLQFITLEPNSLFLPVVLHTDMVFYVHTGSGKLTWMNENEEKSVDLRIGDVFRLPFGSIFFLESDLDPIRHKLRLYSIFPNSGRESLSEPYSSIRKMVLGFDKKVLQAAFHVPEDVIEEVLAGTEVPAIVHGVPKSTKKKKNLWEMEAQFMKTVLGRGSYSFFDNRRNKKKSSQLFNVFQEKPDFENCNGWSTVINRKKLPALKGSQIGIYVVNLTKGSMMGPHWNPMATEIGIAIQGEGMVRVVCSKSGTGCKNMRFKVEEGDVFVVPRFDPMAQMAFNNNSFVFVGFSTTTKKHHPQYLTGKASVLRTLDRQILEASFNVGNTTMHQILEAQGDSVILECTSCAEEEKRLMEEEMRKEEEEAKKKEEARKAEEERREKEAEEERKRQEEEARKREEEEIRRRQEEEEARRRQEEEEEERERQEARKKQEEEEAAQREAEQARREEEEAEKRRQEEEESRREEKARRRQQEEARRREEEEAAKRQHEEEAEREAEEARRIEEEEAQREAEEARRIQQEEEAERARRREEEAETRRKEEEEEESRRQEEESRRSEEEAAREAERERQEEAERQEEARRREEETEERHQQEETEEEEPGQPEMNGYSSN

SEQ ID NO: 207 - DNA, 633 bp, Artificial Sequence
  Description of Artificial Sequence: Synthetic polynucleotide
atgggtgattctgacgtcggtgatcgtcttccccctccatcttcttccgacgaactctcgagctttctccgacagattctttcccgtactcctacagctcaaccttcttcaccaccgaagagtactaatgtttcctccgctgagaccttcttcccttccgtttccggcggagctgtttcttccgtcggttatggagtctctgaaactggccaagacaaatatgctttcgaacacaagagaagtggagctaaacagagaaattcgttgaagagaaacattgatgctcaattccacaacttgtctgaaaagaagaggaggagcaagatcaacgagaaaatgaaagctttgcagaaactcattcccaattccaacaagactgataaagcctcaatgcttgatgaagctatagaatatctgaagcagcttcaacttcaagtccagactttagccgttatgaatggtttaggcttaaaccctatgcgattaccacaggttccacctccaactcatacaaggatcaatgagaccttagagcaagacctgaacctagagactcttctcgctgctcctcactcgctggaaccagctaaaacaagtcaaggaatgtgcttttccacagccactctgctttga

SEQ ID NO: 208 - protein, 210 aa, Artificial Sequence
  Description of Artificial Sequence: Synthetic polypeptide
MGDSDVGDRLPPPSSSDELSSFLRQILSRTPTAQPSSPPKSTNVSSAETFFPSVSGGAVSSVGYGVSETGQDKYAFEHKRSGAKQRNSLKRNIDAQFHNLSEKKRRSKINEKMKALQKLIPNSNKTDKASMLDEAIEYLKQLQLQVQTLAVMNGLGLNPMRLPQVPPPTHTRINETLEQDLNLETLLAAPHSLEPAKTSQGMCFSTATLL

SEQ ID NO: 209 - DNA, 1047 bp, Artificial Sequence
  Description of Artificial Sequence: Synthetic polynucleotide
atggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaa

SEQ ID NO: 210 - protein, 348 aa, Artificial Sequence
  Description of Artificial Sequence: Synthetic polypeptide
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 211 - DNA, 975 bp, Artificial Sequence
  Description of Artificial Sequence: Synthetic polynucleotide
atggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaa

SEQ ID NO: 212 - protein, 324 aa, Artificial Sequence
  Description of Artificial Sequence: Synthetic polypeptide
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 213 - DNA, 2103 bp, Artificial Sequence
  Description of Artificial Sequence: Synthetic polynucleotide
atggaaaggatacctgaagttagagaatcaactaggcagtttcctataggggctaaggtggctcatactttctcaacctccaagaaggaggtcggtattagaggctttcgagattttgacttggctattccaatacaaacatggaaaggaaagacctcctatcaggaggaagaagacctgatggtcgatgctggtacaatcaagcgtagtgatgattcacttgaagatagtggctctacatcatttcatggggcgagtcatcctccggaacctgttgatacagacctaatgagaccagtgtatgtaccaattggtcaaaacaaagcagatgggaaatgtctggtgaaaaacgtatctttgaagggtcctttcttggacgatctttcaatccggatgccaaatgtgaaaccaagcccatcccttctttcaccggcagagagcttggttgaagagccaaatgatctaggtgtaatctcctctccatttacagttcctcgtccttctcaaaacacagaaaccagtctgcctcctgattccgaagagaaagaatgtatttgggatgcatcactgcctccaagcggaaatgtgagtccacttagtagcattgatagtactggtgttgtgagatctatgagtattgtcaacagttgcacaagcacgtacaggagtgatgtgcttatgagtgatggcatgcttagtgtggacagaaactatgagagcacgaaagggagcattcgaggggattcactcgaaagtggtaaaactagccttagcagagcaagtgacagtagtggacttagtgatgatagtaattggagtaacatcactggcagtgccaataagcctcacaaaggaaatgatcctagatggaaggctattctcgcaattcgggcacgtgatggtatattaggcatgagccactttaagttactcaaaagacttggttgtggagacattggaagtgtttatctttctgagcttagcgggactcgctgctattttgcaatgaaagtgatggataaggcatcacttgcaagcaggaagaaattgacgcgtgctcagacagaaagagaaatcctacagttattagaccatccattcttgccaacattgtacactcattttgagaccgatcgcttctcatgtttggtcatggaatattgtcctggaggagatctgcatactctacgacagcgacaacctgggaagcatttttcagaatatgctgcaaggttttatgcagcagaagttctattggcgcttgaatatctacatatgcttggtgtagtgtacagggatttaaaacctgaaaatgttcttgtgcgtgacgatggccacattatgctttcagattttgacctctccttgagatgtgcagtttcacctacgctcataaggatctcatctgatgatccttctaaacgaggagctgcattttgtgtgcagccagcctgtattgagcccacaactgtatgcatgcagccagcatgctttcttccacgtttatttcctcaaaagagcaagaaaaaaacacctaagcctcgagctgattctgggtttcaagctaattcaatgcctgagctagttgcggaacctacttcagcacggtcaatgtcatttgttgggactcatgaatatttggcccccgagattatcaagggagaaggccatggcagtgcagttgactggtggacatttggtattttccttcatgaactactctatggaaagacccctttcaagggatcaggaaacagggcaactcttttcaatgtagttggccaacaacttaaatttccagattctcctgcaaccagttatgccagccgtgatctgatacgtggcttgcttgttaaagagcctcaaaaccggcttggggtgaaacgaggagcaactgagatcaagcaacatcctttctttgaaggtgttaattgggctctaatacgttgcagtacaccacctgaagtgccaagacccgtggagccagactaccctgcgaagtacgggcaagtgaaccctgttggggttggcaataccagtaaaagagtggtaggggcagatgcaaagtctgggggtaaatatcttgactttgagttcttttag

SEQ ID NO: 214 - protein, 700 aa, Artificial Sequence
  Description of Artificial Sequence: Synthetic polypeptide
MERIPEVRESTRQFPIGAKVAHTFSTSKKEVGIRGFRDFDLAIPIQTWKGKTSYQEEEDLMVDAGTIKRSDDSLEDSGSTSFHGASHPPEPVDTDLMRPVYVPIGQNKADGKCLVKNVSLKGPFLDDLSIRMPNVKPSPSLLSPAESLVEEPNDLGVISSPFTVPRPSQNTETSLPPDSEEKECIWDASLPPSGNVSPLSSIDSTGVVRSMSIVNSCTSTYRSDVLMSDGMLSVDRNYESTKGSIRGDSLESGKTSLSRASDSSGLSDDSNWSNITGSANKPHKGNDPRWKAILAIRARDGILGMSHFKLLKRLGCGDIGSVYLSELSGTRCYFAMKVMDKASLASRKKLTRAQTEREILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIRISSDDPSKRGAAFCVQPACIEPTTVCMQPACFLPRLFPQKSKKKTPKPRADSGFQANSMPELVAEPTSARSMSFVGTHEYLAPEIIKGEGHGSAVDWWTFGIFLHELLYGKTPFKGSGNRATLFNVVGQQLKFPDSPATSYASRDLIRGLLVKEPQNRLGVKRGATEIKQHPFFEGVNWALIRCSTPPEVPRPVEPDYPAKYGQVNPVGVGNTSKRVVGADAKSGGKYLDFEFF

SEQ ID NO: 215 - DNA, 1068 bp, Artificial Sequence
  Description of Artificial Sequence: Synthetic polynucleotide
atggctttttctgcaccatcactttccaaattctctcttttggttgccatttcagcatcagctctcctctgttgtgcttttgcccgtgatttctccattgttggatacacgccggagcatttgacaaacactgacaagcttctagagctcttcgagtcatggatgtcagaacacagcaaggcttacaaaagcgtggaggagaaggtgcacaggtttgaggttttcagagagaatctgatgcatatagaccagaggaacaatgagatcaacagttactggctcggtttgaacgagtttgcggatttgacccatgaagagttcaaaggaagatatctaggacttgcaaagccacaattctctagaaagagacagccctcagctaacttcaggtacagagatatcacggacttgcctaaatccgtagactggagaaagaaaggcgctgtggctcctgtcaaggaccagggtcaatgtggtagctgttgggcattttcaacagttgcagctgtcgaggggatcaaccagatcacaacagggaatctgagttcgctttcagagcaagaactcatagactgtgacacaactttcaacagtggctgcaatggaggtctcatggactacgcattccagtacataatttcgaccggtggtctccacaaagaagatgattacccttatctcatggaggaaggaatttgtcaagagcagaaagaggatgtggaacgtgtgacaatcagcggctacgaagatgtccctgaaaatgatgacgaaagcctggtgaaggctttagctcatcagccagtcagtgtggctattgaggcttcaggaagagacttccagttctacaaagggggagtgtttaatggtaaatgtggaacagacctagaccacggtgtggcagcggttggatatggttcatcaaagggatctgactatgttattgtcaagaactcatggggaccaagatggggagagaaagggtttattaggatgaagagaaacactggtaaaccagagggactctgtggaatcaacaagatggcctcatatcctaccaagaccaagtga

SEQ ID NO: 216 - protein, 355 aa, Artificial Sequence
  Description of Artificial Sequence: Synthetic polypeptide
MAFSAPSLSKFSLLVAISASALLCCAFARDFSIVGYTPEHLTNTDKLLELFESWMSEHSKAYKSVEEKVHRFEVFRENLMHIDQRNNEINSYWLGLNEFADLTHEEFKGRYLGLAKPQFSRKRQPSANFRYRDITDLPKSVDWRKKGAVAPVKDQGQCGSCWAFSTVAAVEGINQITTGNLSSLSEQELIDCDTTFNSGCNGGLMDYAFQYIISTGGLHKEDDYPYLMEEGICQEQKEDVERVTISGYEDVPENDDESLVKALAHQPVSVAIEASGRDFQFYKGGVFNGKCGTDLDHGVAAVGYGSSKGSDYVIVKNSWGPRWGEKGFIRMKRNTGKPEGLCGINKMASYPTKTK

SEQ ID NO: 217 - DNA, 1071 bp, Artificial Sequence
  Description of Artificial Sequence: Synthetic polynucleotide
atggctctttcttcaccttcaagaatcctctgttttgctcttgccttatccgctgcttctctctccctctctttcgcttcttcccacgattactccatcgttggatactcccccgaggatttggaatctcatgacaaactcatagaactcttcgaaaactggatctcaaattttgagaaagcttatgaaaccgttgaagagaagtttcttaggttcgaagttttcaaggataatctaaagcacatcgatgagactaacaagaaagggaaaagctactggctcgggctcaacgagtttgcggatttgagccatgaggagttcaagaaaatgtatttagggctcaagactgatatagtgagacgcgatgaagaaagatcttacgcagagttcgcttacagggacgtcgaagctgttcctaagtctgttgactggagaaagaaaggagctgtggcggaagttaagaaccagggctcttgtggaagttgttgggcgttttcgacagtagcagctgtcgaaggtataaacaagattgtgacaggaaacttgacaacattgtcagaacaagaactcatagactgtgacacgacctacaacaatggctgcaacggtggtctcatggactatgcctttgagtacattgttaagaacggaggtctacgcaaggaagaagattatccttactctatggaagaaggaacttgcgagatgcaaaaggatgaatctgaaacagtaaccattaatggacaccaagacgtacctactaatgatgagaagagtctcttgaaggcattggctcatcagcctctcagtgtcgccattgatgcatctggtagagagttccagttctatagcggcggcgtgtttgatgggcggtgcggggttgatcttgaccacggtgtggctgcggttgggtatggatcaagcaagggttcagattacatcattgtgaagaattcttggggaccaaaatggggagaaaaaggttacatcaggctgaagaggaacactgggaaaccagagggtctctgtggaatcaacaagatggcttctttccccaccaaaactaagtga

SEQ ID NO: 218 - protein, 356 aa, Artificial Sequence
  Description of Artificial Sequence: Synthetic polypeptide
MALSSPSRILCFALALSAASLSLSFASSHDYSIVGYSPEDLESHDKLIELFENWISNFEKAYETVEEKFLRFEVFKDNLKHIDETNKKGKSYWLGLNEFADLSHEEFKKMYLGLKTDIVRRDEERSYAEFAYRDVEAVPKSVDWRKKGAVAEVKNQGSCGSCWAFSTVAAVEGINKIVTGNLTTLSEQELIDCDTTYNNGCNGGLMDYAFEYIVKNGGLRKEEDYPYSMEEGTCEMQKDESETVTINGHQDVPTNDEKSLLKALAHQPLSVAIDASGREFQFYSGGVFDGRCGVDLDHGVAAVGYGSSKGSDYIIVKNSWGPKWGEKGYIRLKRNTGKPEGLCGINKMASFPTKTK

SEQ ID NO: 219 - DNA, 1257 bp, Artificial Sequence
  Description of Artificial Sequence: Synthetic polynucleotide
atgacgaaaaaggcggtgcttattgggatcaattacccaggaaccaaggcggagttacggggatgcgtcaacgatgttcgtcgtatgtacaaatgtctcgttgaacggtacggcttctccgaggagaacatcaccgttctcatcgacaccgatgaatcctctactcagcctactggcaagaacatccgccgcgcgcttgctgatctcgtcgaatctgccgattccggcgacgttcttgtcgttcattacagtggacacggtacgaggttgccggctgagactggtgaagacgatgacactggtttcgacgagtgtattgttccttgcgacatgaatctgattactgatgatgattttagagatcttgtggacaaggttcctccaggttgcagaatgacaatcatttcagactcttgtcacagtggtggcctaatcgacgaagccaaggagcagattggagagagcactaagaaagaagccgaggacgaagatgaatctgaagaatcttcttcaagattcgggtttaggaagttcttgcgcagcaaagtggaaggcgccatcgagtctcgagggtttcacattggagggaacaagaaggatgaagatgaggcggaagaaatcgagactaaggagattgagcttgaagacggagaaacgatccatgccaaagacaaatctcttcctctgcagaccttgattgatattctcaagcagcaaacagggaatgataatatcgaagttgggaaaatcaggccaagcctttttgatgcgtttggtgatgattcgagcccgaaagtgaagaagtttatgaaagtgatcttaggtaagcttcaggctggaaatggagaagaaggtggattaatgggaatgcttggcaaattggcttcagggtttcttgagggtaaactaaacgatgaagactatgtgaaacccgctatgcagacacacgttgggagtaaagaagaggtttatgctggtggatcaagaggttcggttccgcttccagacagcgggatactgatcagcggttgccaaaccgatcagacctctgctgatgcgactccagcggggaaaccaactgaggcttatggagcgatgagcaattcgatacagacgatattggaggagacagacggtgagatatcaaacagagaaatggttacaagggctaggaaggcattgaagaagcaagggtttactcagcagccaggtttgtattgccatgatggttatgccaacgctcctttcatctgttga

SEQ ID NO: 220 - protein, 418 aa, Artificial Sequence
  Description of Artificial Sequence: Synthetic polypeptide
MTKKAVLIGINYPGTKAELRGCVNDVRRMYKCLVERYGFSEENITVLIDTDESSTQPTGKNIRRALADLVESADSGDVLVVHYSGHGTRLPAETGEDDDTGFDECIVPCDMNLITDDDFRDLVDKVPPGCRMTIISDSCHSGGLIDEAKEQIGESTKKEAEDEDESEESSSRFGFRKFLRSKVEGAIESRGFHIGGNKKDEDEAEEIETKEIELEDGETIHAKDKSLPLQTLIDILKQQTGNDNIEVGKIRPSLFDAFGDDSSPKVKKFMKVILGKLQAGNGEEGGLMGMLGKLASGFLEGKLNDEDYVKPAMQTHVGSKEEVYAGGSRGSVPLPDSGILISGCQTDQTSADATPAGKPTEAYGAMSNSIQTILEETDGEISNREMVTRARKALKKQGFTQQPGLYCHDGYANAPFIC

SEQ ID NO: 221 - DNA, 2965 bp, Artificial Sequence
  Description of Artificial Sequence: Synthetic polynucleotide
gtgatcaattccagtgtgcacaccacttgtttgatgaattgtctctgtggagatttttttttagatgggaggttgtttctctgtttcattgccatgtgatcaagtagtgagtcagttctctcagttgttatgtgtcaggggaagttatattcacaatctctccaagaatctggcttctctgcagaaggccatgcgaatgctcaaggctcggcaatatgatgtgataagaaggttggaaacagaagagtttacagggcgtcaacaaaggctttcccaagttcaggtatggcttactagtgtcctaatcattcaaaaccagtttaatgatctgcttcgtagtaatgaagttgagcttcaaaggttgtgtctttgtggtttctgctccaaagatttgaaattgagctatcgttatgggaaaagagttatcatgatgttgaaggaagttgagagtctcagttctcaaggattctttgatgtggtttctgaggcaactccgtttgctgatgtggatgagatcccttttcaacccacaattgttggtcaggagataatgcttgaaaaggcatggaaccgtctcatggaagatggatccgggattttgggtctgtacggtatggggggagtaggcaaaacgacactactcacgaagatcaacaataagttttctaaaatagatgacagatttgatgttgtgatatgggttgttgtgtctagaagttcaacagtccgtaagatacaaagagacatagcagaaaaggtaggccttgggggaatggagtggagcgagaaaaacgataaccagatagccgttgacatccacaatgtccttaggagacgaaagtttgttttattgttggatgacatatgggagaaagtgaatttaaaagcggttggagtcccgtatccaagcaaagataacggatgcaaggtagcattcactactcgttctcgagatgtgtgtgggcgcatgggggttgatgatccgatggaagttagctgtctacaacccgaagaatcttgggatttgtttcaaatgaaggttgggaaaaatacactgggaagtcacccagacattcccggacttgctagaaaagtcgctaggaaatgtcgtggcctaccattagcactcaatgttatcggtgaagctatggcatgcaaaagaacagtacatgaatggtgtcatgccattgacgttttaacatcatctgccatagatttttcaggtatggaagatgaaattctccatgttttgaagtatagctatgataatttaaatggggagctgatgaaatcctgcttcctctattgctctctgtttcctgaagactatcttattgataaagaggggttggtagactactggataagtgagggattcataaatgaaaaagaaggcagagagaggaatattaaccaaggttatgagataattggtacccttgtccgtgcatgtttgttgttggaggaagaaaggaacaaatcaaacgtgaaaatgcatgatgtggttcgtgagatggctctatggatatcatccgatcttgggaagcaaaaggagaaatgtattgtgcgagctggtgttgggttacgtgaagtaccaaaagtcaaggattggaacactgtgagaaagatttctttgatgaataatgagattgaagagatatttgacagtcacgagtgtgctgcacttacaactctatttctccaaaagaacgacgtggtaaagatctcggctgaattctttcgatgtatgcctcatctggtggttttagatctatcagagaatcagagtcttaatgaattaccagaagaaatatcagagctggcctctttgagatatttcaacttgtcatatacatgtatacatcaactacccgttggtttatggacattgaaaaagctaatacatctgaatctcgaacacatgagcagtcttgggagtatattagggatatcaaatttgtggaatttgaggacattgggactacgagattccagactgttgctagatatgagtttagtgaaggagctgcagctcttagaacatctagaagttataaccctagatatatcatcaagtttggttgcagagccattgttatgctctcaaaggttggtggaatgtataaaagaggtagattttaagtaccttaaggaagaatcagtgagagtattgactttgccaaccatgggtaatctccgcaagctcgggataaaaagatgtggaatgagggagataaagatagagaggacaacttcatcatcgtctcggaacaaaagtcccacaactccatgcttctcaaacctctccagagtctttatagctaaatgccatggtcttaaggatttgacgtggcttttgtttgctcctaatcttacttttcttgaagttgggttctcaaaggaagtagaggatataattagtgaagagaaagctgaggagcattcagctacgattgttccttttaggaaattggagacactacacctgtttgaattacgcgggctcaagagaatctatgcaaaggctctgcattttccgtgtctgaaagttatccacgtagaaaaatgtgaaaagctgagaaagcttccattggattctaaaagtgggatcgcgggtgaagaacttgtcatatattatggagagagagaatggatagaaagggttgaatgggaggaccaagcaactcaactccgtttcttaccttcatccaggtggcggtggagagaaacataatgaacttcactttcttctacaaacttttgttgtcatggtctaaagacatttgccggtgtgtaaatctcttccttgtctcttcttgtttgcataaccgttctcatcgttcttttggttagtgatcattggatttgtacttatctctttctctaaacgatgagtgtttgtttcggcttcatagaaacattacacagagactcatgagaaaatgaataaaaacttgcaagttcc

SEQ ID NO: 222 - protein, 889 aa, Artificial Sequence
  Description of Artificial Sequence: Synthetic polypeptide
MGGCFSVSLPCDQVVSQFSQLLCVRGSYIHNLSKNLASLQKAMRMLKARQYDVIRRLETEEFTGRQQRLSQVQVWLTSVLIIQNQFNDLLRSNEVELQRLCLCGFCSKDLKLSYRYGKRVIMMLKEVESLSSQGFFDVVSEATPFADVDEIPFQPTIVGQEIMLEKAWNRLMEDGSGILGLYGMGGVGKTTLLTKINNKFSKIDDRFDVVIWVVVSRSSTVRKIQRDIAEKVGLGGMEWSEKNDNQIAVDIHNVLRRRKFVLLLDDIWEKVNLKAVGVPYPSKDNGCKVAFTTRSRDVCGRMGVDDPMEVSCLQPEESWDLFQMKVGKNTLGSHPDIPGLARKVARKCRGLPLALNVIGEAMACKRTVHEWCHAIDVLTSSAIDFSGMEDEILHVLKYSYDNLNGELMKSCFLYCSLFPEDYLIDKEGLVDYWISEGFINEKEGRERNINQGYEIIGTLVRACLLLEEERNKSNVKMHDVVREMALWISSDLGKQKEKCIVRAGVGLREVPKVKDWNTVRKISLMNNEIEEIFDSHECAALTTLFLQKNDVVKISAEFFRCMPHLVVLDLSENQSLNELPEEISELASLRYFNLSYTCIHQLPVGLWTLKKLIHLNLEHMSSLGSILGISNLWNLRTLGLRDSRLLLDMSLVKELQLLEHLEVITLDISSSLVAEPLLCSQRLVECIKEVDFKYLKEESVRVLTLPTMGNLRKLGIKRCGMREIKIERTTSSSSRNKSPTTPCFSNLSRVFIAKCHGLKDLTWLLFAPNLTFLEVGFSKEVEDIISEEKAEEHSATIVPFRKLETLHLFELRGLKRIYAKALHFPCLKVIHVEKCEKLRKLPLDSKSGIAGEELVIYYGEREWIERVEWEDQATQLRFLPSSRWRWRET

SEQ ID NO: 223 - DNA, 3435 bp, Artificial Sequence
  Description of Artificial Sequence: Synthetic polynucleotide
atggcatcttcttcttcttcttctagatggagctatgatgttttcttaagttttagaggcgaagatactcgaaaaacgtttacaagtcacttatacgaagtcttgaatgataagggaataaaaacctttcaagatgataaaaggctagagtacggcgcaaccatcccaggtgaactctgtaaagctatagaagagtctcaatttgccattgttgttttctcagagaattatgcaacatcaaggtggtgtttgaatgaactagtgaagatcatggaatgcaaaactcgatttaagcaaactgttataccgatattctatgatgtggatccatcacatgttcggaaccaaaaggagagctttgcaaaagcctttgaagaacatgaaacaaagtataaggatgatgttgagggaatacaaagatggaggattgctttaaatgaagcggccaatctcaaaggctcctgtgataatcgtgacaagactgatgcagactgtattcgacagattgttgaccaaatctcatccaaattatgcaagatttctttatcttatttgcaaaacattgttggaatagatactcatttagagaaaatagaatccttactagagataggaatcaatggtgttcggattatggggatctggggaatggggggagtcggtaaaacaacaatagcaagagctatatttgatactcttttaggaagaatggatagttcctatcaatttgatggtgcttgtttccttaaggatattaaagaaaacaaacgtggaatgcattctttgcaaaatgcccttctctctgaacttttaagggaaaaagctaattacaataatgaggaggatggaaagcaccaaatggctagtagacttcgttcgaagaaggtcctaattgtgcttgatgatatagataataaagatcattatttggagtatttagcaggtgatcttgattggtttggtaatggtagtagaattattataacaactagagacaagcatttgatagagaagaatgatataatatatgaggtgactgcactacccgatcatgaatccattcaattgttcaaacaacatgctttcggaaaagaagttccaaatgagaattttgagaagctttcattagaggtagtaaattatgctaaaggccttcctttagccctcaaagtgtggggttctttgctgcataacctacgattaactgaatggaaaagtgctatagagcacatgaaaaataactcttattctggaattattgataagctcaaaataagttatgatggattagagcccaaacaacaagagatgtttttagatatagcatgcttcttgcgaggggaagaaaaagattacatcctacaaatccttgagagttgtcatattggagctgaatacgggttacgtattttaattgacaaatctcttgtgttcatctctgaatataatcaggttcaaatgcatgacttaatacaggatatgggtaaatatatagtgaattttcaaaaagatcccggagaacgtagcagattatggctcgccaaggaagtcgaagaagtgatgagcaacaacacagggaccatggcaatggaagcaatttgggtttcttcttattctagtactctacgctttagcaatcaggccgtgaaaaatatgaaaaggcttagggtatttaacatggggaggtcgtcgacacattatgccatcgattatctgcccaacaacttgcgttgttttgtttgcactaactatccttgggagtcatttccatctacatttgaactcaaaatgcttgttcacctccaactccgacacaattctctgcgtcatttatggacagaaacaaagcatttgccgtctctacggaggatagatctcagctggtctaaaagattgacgcgaacaccagatttcacggggatgccaaatttggagtatgtgaatttgtatcaatgtagtaatcttgaagaagttcaccattccctgggatgttgcagcaaagtcattggtttatatttgaatgattgtaaaagccttaagaggtttccatgtgttaacgtggaatctcttgaatatctgggtctaagaagttgcgatagtttagagaaattgccagaaatctacgggagaatgaagccggagatacagattcacatgcaaggctctgggataagggaactaccatcatctatttttcagtacaaaactcatgttaccaagctattgttgtggaatatgaaaaaccttgtagctcttccaagcagcatatgtaggttgaaaagtttggttagtctgagtgtgtcgggttgctcaaaacttgaaagcttgccagaagagataggggatttagacaacttacgggtgtttgatgccagtgatactctaattttacgacctccgtcttccatcatacgcttgaacaaacttataatcttgatgtttcgaggcttcaaagatggagtgcactttgagttccctcctgtggctgaaggattacactcattggaatatctgaatctcagttactgcaatctaatagatggaggacttccggaagagattggatccttatcctctttgaaaaagttggatctcagtagaaataattttgagcatttgccttcaagtatagcccaacttggtgctcttcaatccttagacttaaaagattgccagaggcttacacagctaccagaacttcccccagaattaaatgaattgcatgtagattgtcatatggctctgaaatttatccattatttagtaacaaagagaaagaaactacatagagtgaaacttgatgatgcacacaatgatactatgtacaatttgtttgcatataccatgtttcagaatatctcttccatgaggcatgacatctctgcttcagattccttgtcactaacagtatttaccggtcaaccgtatcctgaaaagatcccgagttggttccaccatcagggttgggatagtagtgtatcagtcaatttgcctgaaaattggtatatacctgataaattcttgggatttgctgtatgttactctcgtagcttaattgacacaacagctcacttgattcccgtatgtgatgacaagatgtcgcgcatgacccagaaacttgccttatcagaatgtgatacagaatcatccaactattcagaatgggatatacattttttctttgtaccttttgctggcttatgggatacatctaaggcaaatggaaaaacaccaaatgattatgggattattaggctatctttttctggagaagagaagatgtatggacttcgtttgttgtataaagaaggaccagaggttaatgccttgttacaaatgagggaaaatagcaatgaaccaacagaacattccactgggataaggaggactcaatataacaacagaacttccttttatgagctcatcaatgggtga

SEQ ID NO: 224 - protein, 1144 aa, Artificial Sequence
  Description of Artificial Sequence: Synthetic polypeptide
MASSSSSSRWSYDVFLSFRGEDTRKTFTSHLYEVLNDKGIKTFQDDKRLEYGATIPGELCKAIEESQFAIVVFSENYATSRWCLNELVKIMECKTRFKQTVIPIFYDVDPSHVRNQKESFAKAFEEHETKYKDDVEGIQRWRIALNEAANLKGSCDNRDKTDADCIRQIVDQISSKLCKISLSYLQNIVGIDTHLEKIESLLEIGINGVRIMGIWGMGGVGKTTIARAIFDTLLGRMDSSYQFDGACFLKDIKENKRGMHSLQNALLSELLREKANYNNEEDGKHQMASRLRSKKVLIVLDDIDNKDHYLEYLAGDLDWFGNGSRIIITTRDKHLIEKNDIIYEVTALPDHESIQLFKQHAFGKEVPNENFEKLSLEVVNYAKGLPLALKVWGSLLHNLRLTEWKSAIEHMKNNSYSGIIDKLKISYDGLEPKQQEMFLDIACFLRGEEKDYILQILESCHIGAEYGLRILIDKSLVFISEYNQVQMHDLIQDMGKYIVNFQKDPGERSRLWLAKEVEEVMSNNTGTMAMEAIWVSSYSSTLRFSNQAVKNMKRLRVFNMGRSSTHYAIDYLPNNLRCFVCTNYPWESFPSTFELKMLVHLQLRHNSLRHLWTETKHLPSLRRIDLSWSKRLTRTPDFTGMPNLEYVNLYQCSNLEEVHHSLGCCSKVIGLYLNDCKSLKRFPCVNVESLEYLGLRSCDSLEKLPEIYGRMKPEIQIHMQGSGIRELPSSIFQYKTHVTKLLLWNMKNLVALPSSICRLKSLVSLSVSGCSKLESLPEEIGDLDNLRVFDASDTLILRPPSSIIRLNKLIILMFRGFKDGVHFEFPPVAEGLHSLEYLNLSYCNLIDGGLPEEIGSLSSLKKLDLSRNNFEHLPSSIAQLGALQSLDLKDCQRLTQLPELPPELNELHVDCHMALKFIHYLVTKRKKLHRVKLDDAHNDTMYNLFAYTMFQNISSMRHDISASDSLSLTVFTGQPYPEKIPSWFHHQGWDSSVSVNLPENWYIPDKFLGFAVCYSRSLIDTTAHLIPVCDDKMSRMTQKLALSECDTESSNYSEWDIHFFFVPFAGLWDTSKANGKTPNDYGIIRLSFSGEEKMYGLRLLYKEGPEVNALLQMRENSNEPTEHSTGIRRTQYNNRTSFYELING

SEQ ID NO: 225 - RNA, 20 nt, Artificial Sequence
  Description of Artificial Sequence: Synthetic oligonucleotide
uuggauugaagggagcucug

SEQ ID NO: 226 - DNA, 188 bp, Artificial Sequence
  Description of Artificial Sequence: Synthetic polynucleotide
gttttgagagtggagctccttgaagtccaacagaggatctaacaggtaagattgagctgctgacctatggattcctcagccctatctattatttgattggataggtttgtgggttgcatatgtcaggagcttcattgccctaagttggatccctttttggattgaagggagctctacattcatttgac

SEQ ID NO: 227 - RNA, 20 nt, Artificial Sequence
  Description of Artificial Sequence: Synthetic oligonucleotide
uuuggauugaagggagcucu

SEQ ID NO: 228 - DNA, 1107 bp, Artificial Sequence
  Description of Artificial Sequence: Synthetic polynucleotide
atggtggatgggcatgtatcagctggttcaagaaatgagaacggtacaacacccagaaataataatgtggaaatttcaatagcaacagcgtcatcaatgtttcctggtttcaggttttcaccaacggacgaagaactcatatcatattacttgaaaaagaaacttgaggggtctgataagtgtgttgaagttatttctgaggttgagatttggaaacatgaaccttgggatttaccagcaaaatccgtcattcaatcagataatgaatggttcttcttttctcctcgtggaaggaagtatccaaacgggtcgcaaagtaaaagggcaactgaatctggttactggaaggccacaggaaaagaacgtaatgtgaaatctggttcgaatctcattggcacaaagagaactctggtgttccacactggtcgagcacctaaaggacagaggacacattggataatgcatgaatattgcatgagcggaaacactaattatcaggattctatggttgtctgccgcctccggaagaatagtgagtttcatttgaatgacaccccaagaaatcaaaggaatcaactggctgctaccgctactgcaaccgctcagtctggagcaggacaattgggcagcttggaattggtcactgtaggggattgctgttgttcaaaggaagggagtagcagtttttattcccattcggttgagcagattgactctggatcagaatctgataaaccaactaaagagttctctcagcacgattcctctggccacttcaaggactgtgatggcgaggaggactggtttgctgatataatgaaagatgatatcattaagctagacgaatcttcgttgaatgcccaacctatttccatggttcccagtaggcctgaatcctcgatatcaactcatgaagctcgagctgcgatgtccggtgtggctcctttccagggcaccgctaatcgaagactcagactagtaagggaaaaagtagtggtgtgtccagtagagggatccagaatgtatgaagctaccaaaaagaataaaatcggagtgagcataactagttcaggaagatggctgagaaacatgttttcagttaaatga

SEQ ID NO: 229 - protein, 368 aa, Artificial Sequence
  Description of Artificial Sequence: Synthetic polypeptide
MVDGHVSAGSRNENGTTPRNNNVEISIATASSMFPGFRFSPTDEELISYYLKKKLEGSDKCVEVISEVEIWKHEPWDLPAKSVIQSDNEWFFFSPRGRKYPNGSQSKRATESGYWKATGKERNVKSGSNLIGTKRTLVFHTGRAPKGQRTHWIMHEYCMSGNTNYQDSMVVCRLRKNSEFHLNDTPRNQRNQLAATATATAQSGAGQLGSLELVTVGDCCCSKEGSSSFYSHSVEQIDSGSESDKPTKEFSQHDSSGHFKDCDGEEDWFADIMKDDIIKLDESSLNAQPISMVPSRPESSISTHEARAAMSGVAPFQGTANRRLRLVREKVVVCPVEGSRMYEATKKNKIGVSITSSGRWLRNMFSVK

SEQ ID NO: 230 - DNA, 3822 bp, Artificial Sequence
  Description of Artificial Sequence: Synthetic polynucleotide
atgtatcccatgtatgggttcatggacacacatccttaccaaagaaaccgagtacctcacaaccctccttattatccccagtttgaaccgaatcatcatcatctgaacattgatccagctagatctcctgtagcttatgaatcctggccttgtggtggtaactatgggcatccttatccaccgcagtgtcacagttgctgtatccataacaattccccgagccagtgtgcattcggtcctccttatccctaccttccactgcctccctacaacaactgtagcaatccagcatatccggtgatgtatgctgctaattatgtttctccccattttactatggagcagcctcggtacgaatatgataagaatatgggaagtggtcatcacttctgtggctgtccaaatcatccatgttatacgaaaggagggagcaacattaaaatagaagaacaggaccaggataagaaaaatgaaagcaatgagtccttggttccttttgggttcaagaattgtccttatcctgttctgtggatgccacctgattatatgatgaatagcgcacacgtgaagcctaatggatttgaaggtaaacgggatgaggtgaaagatgtgaaaccgtatggtgattgcagatctttcgaacaaccaaatatctggaatgtatggtctccttatcaagggaacaactcggaattaccaaagcaaaggggagatccacccagaaaacaacaccacgatgatatgaacaagaaacagtttccatttccaataatctggatgccttacaaacctgaggaaatagacggcaaagttagcaaggagactggtgttgatcaggagcagacctcccccttaaaatctaccataccaaagttacatgatgttgaagaggatagaagcgattctagagaaaatgtagtgaatagaggaagtgaaatccacggaaagggactgaataaagattctgttacgaaaatcattccagtaaggcaaatggagcaaattgaggatgtcttggatggaaaaccggaagatgcttccaaacagcatgatgttgatgctaaagagaagaaaaccactgaagacggtggcaagaagcagtcgtcttctcctacaaagtcatccaagctgccccctgtttgtctaagagttgatcccctgcctaggaaaaaaagcagtaacggcagttctaggtcccctagtcctcctggtgggaaacggaaattagtagattcgccaagtgacagctccaaacctcccatcttatcaaatgagaaggagaatgttcatcttgacaaatcatccacaacagctacgccggagaaaagcatagaagtggatccaagtgaaggaaaaagaaaagttgttaaggttgcccaagggactagcaaagaagataaacttcaagatcaatatacggttttccctgatctgaaagggaaggcaaggggccaaagcagtgagggtgatactagtaaagcaaccaatgagctcaagcatcaacctgatggagtagcagcagaacctcagtccaacaatcaaggacatcagattggtgaggccagagaagcagcgaagggaaatgcgggtttagttgtgtacatgaaaccagataggagtaagctgtctgatgataacgcggctactgtgattcagtcggcataccgagggttcaacgtgcggagatgggagcctctgaagaaattaaagcagataactaaaataaaggagcagatggctgagcttaaaaactgtattcaggctttggagagctcagctgacaacaaacagatgactattctcacagaagccataatgggtcttctgctgaagcttgacgctattcaggggttacatccaaccgttagggaatatagaaaatctgtagcaaaggagcttgttagcctgcaggagaagctggatcttctgaactgtaagaagcaactggcagaaagtgaacaggctttaactgctcaatccagcggggatgcatgcaggacggtggaagacaacatttccatgcagggaggccgagaggtgccaaagtttgaacaggatgatgatttagcgcggggagatgaagaaataaaggtacatgcaaaggagccctgtcaagagcagcctctttgtgcggcagagacactccccaactctcatcacgtaggcaatgcagaggaagtggtcggtaaagaagaaagtgagaacgttgaggaggtggtggagaacttttcaagtggtggtgcagtggtggatgaggcaacagaatcactttctgaatctaaagaaaatttgaatgataagtcacctgatgagaatacggtagtagttgagaaatcagaagagcatgacaaagctgaacaatctttgccaaatcctattccattttctgtagatctgacagaaaacttgggcttagaggtcagaggttgtggtttgaaggggaagggtggaggtgttgatgaattggaagagctcccgcaaggagtccttgatgaagagactagtgttcaagggtctactgagatcagaaaagacgaggtcctccaacatgacaatggaaaccttactgctcatattcctgaagaaaaagtctctgatacagagaggcgagagcaccaccacttggaagcattaggtgaaacactagttgttttggggccaatgaacatccacagcagcaatggacaaaaagaaaattcagaagttctggaaacagataaaacagtacgagttgatgctccagaacaggagaaagaagatctcagaccattaaatgaagatgggaagatctctgatgttgatgctaaggttggtatggaagaggatggcgaggaacgtggacaatgcagcactgggtcagacgcgtttccaatatactcacaggaagaagcaatcaccatgaagcagtctacagatgccaccaacatggaggaattggaaacaactggagttctgcaggagaaaatgcaaaatgcagtagagagagacattgaaatccttaattcaaaaaaaaccattgaagtgtcagcagaacctcaactatttactgctaccattgacgaggccaaagaatattatgctcaggataagcagaatgttggggaggaaaatatggaggtgcaaggtgaggaattgcctgctcgcagtgatgctttggtctctgtactcaagagtgaacacaaagagaataatgtggaggttgagcagaggcatctggaggaaaactttgagatgcaagaggaagaaccagtggctgctgataaccctgcacctatgaccgaggaaccagtggatgaaagtatagtgatgactgctccaaaatcagaagctgtaactactgagacgcagctgttaggggagaaagagcttggtgtagcagaggaccgcagcacatatccatcgacatgtgatactgtggaaggtaattcagctgatgctgtctgctcttttggttctacgcctaatgaagcacaagtaatggatgcaaaggagcttaaagaatggaagagagtggaaatgtcaccatcatcacctactgctagccaagtatcctttgatagtgatgcattctcagagagcagtcaaaagcttatagaagagaatgaaaaattaagggagatgatggagaaactaataaaagcagggaaagaacaactcactgttgtatccagtctttctggaagagttaaggacctggagaagagattgtccaggaagaagaagctgagattgagacgatatagggtaccaagagcaggttcagtctgtatgaagccattgaatgactcactgaaagacagagctgcggggttggcaatgtga

SEQ ID NO: 231 - protein, 1273 aa, Artificial Sequence
  Description of Artificial Sequence: Synthetic polypeptide
MYPMYGFMDTHPYQRNRVPHNPPYYPQFEPNHHHLNIDPARSPVAYESWPCGGNYGHPYPPQCHSCCIHNNSPSQCAFGPPYPYLPLPPYNNCSNPAYPVMYAANYVSPHFTMEQPRYEYDKNMGSGHHFCGCPNHPCYTKGGSNIKIEEQDQDKKNESNESLVPFGFKNCPYPVLWMPPDYMMNSAHVKPNGFEGKRDEVKDVKPYGDCRSFEQPNIWNVWSPYQGNNSELPKQRGDPPRKQHHDDMNKKQFPFPIIWMPYKPEEIDGKVSKETGVDQEQTSPLKSTIPKLHDVEEDRSDSRENVVNRGSEIHGKGLNKDSVTKIIPVRQMEQIEDVLDGKPEDASKQHDVDAKEKKTTEDGGKKQSSSPTKSSKLPPVCLRVDPLPRKKSSNGSSRSPSPPGGKRKLVDSPSDSSKPPILSNEKENVHLDKSSTTATPEKSIEVDPSEGKRKVVKVAQGTSKEDKLQDQYTVFPDLKGKARGQSSEGDTSKATNELKHQPDGVAAEPQSNNQGHQIGEAREAAKGNAGLVVYMKPDRSKLSDDNAATVIQSAYRGFNVRRWEPLKKLKQITKIKEQMAELKNCIQALESSADNKQMTILTEAIMGLLLKLDAIQGLHPTVREYRKSVAKELVSLQEKLDLLNCKKQLAESEQALTAQSSGDACRTVEDNISMQGGREVPKFEQDDDLARGDEEIKVHAKEPCQEQPLCAAETLPNSHHVGNAEEVVGKEESENVEEVVENFSSGGAVVDEATESLSESKENLNDKSPDENTVVVEKSEEHDKAEQSLPNPIPFSVDLTENLGLEVRGCGLKGKGGGVDELEELPQGVLDEETSVQGSTEIRKDEVLQHDNGNLTAHIPEEKVSDTERREHHHLEALGETLVVLGPMNIHSSNGQKENSEVLETDKTVRVDAPEQEKEDLRPLNEDGKISDVDAKVGMEEDGEERGQCSTGSDAFPIYSQEEAITMKQSTDATNMEELETTGVLQEKMQNAVERDIEILNSKKTIEVSAEPQLFTATIDEAKEYYAQDKQNVGEENMEVQGEELPARSDALVSVLKSEHKENNVEVEQRHLEENFEMQEEEPVAADNPAPMTEEPVDESIVMTAPKSEAVTTETQLLGEKELGVAEDRSTYPSTCDTVEGNSADAVCSFGSTPNEAQVMDAKELKEWKRVEMSPSSPTASQVSFDSDAFSESSQKLIEENEKLREMMEKLIKAGKEQLTVVSSLSGRVKDLEKRLSRKKKLRLRRYRVPRAGSVCMKPLNDSLKDRAAGLAM

SEQ ID NO: 232 - DNA, 1122 bp, Artificial Sequence
  Description of Artificial Sequence: Synthetic polynucleotide
atgcgacctcttcaaccacccccaccagccgccgccgccaccacctcctcctccaccaccgcatcacctatgccccctcctccttcacgcaaccgtccccgtcgtcgcaccgatttaactctcccccttccccaacgtgacccagctctcgccgtacccctccccctcccccctacttccgccccttcttcctcgtcgtcttcctcttcctccccactccccacccccttaaacttctccgaacttgagcgtatcaatcgcatcggcagcggcgctggcggtacggtttacaaagtcctacatcgccccaccggaagactctacgctctcaaagtcatctacggtaaccacgaggactccgttcgccttcagatgtgccgtgagatcgagattctccgtgacgtcgacaaccctaacgtcgttagatgtcacgatatgttcgatcacaacggtgaaatccaagtcctccttgaattcatggataaaggctctctcgaagggatccacatccctaaagagtcagctctttcggatctaacccgacaagtcctctcgggtctctattatctccacaggcgtaagattgtgcacagagatatcaagccctcgaatttactaatcaactcgaggcgcgaggtgaaaattgctgactttggggtgtcgagagtgctggcacaagatatggatccttgtaatgattcagttgggacaattgcctatatgagtccagagagaatcaacacagatctgaatcatggacagtacgatgggtatgctggagatatatggagtcttggtgttagcatattggagttttatttgggaaggtttccgttttctgttgggaggtcaggtgattgggctagtcttatgtgcgccatttgtatgtcgcagccgccggaggctccggcgaatgcttctagagagttcagggactttattgcttgctgtttgcagagggatcctgcacgacggtggacggcggtgcagctgttgcgtcatccatttattacccagaatagcccagccgccaccaccaccggtaatatgatgccacttcctaatcaggttcatcagccagcacatcaattgttacctccacctcctcatttttcttcttaa

SEQ ID NO: 233 - protein, 373 aa, Artificial Sequence
  Description of Artificial Sequence: Synthetic polypeptide
MRPLQPPPPAAAATTSSSTTASPMPPPPSRNRPRRRTDLTLPLPQRDPALAVPLPLPPTSAPSSSSSSSSSPLPTPLNFSELERINRIGSGAGGTVYKVLHRPTGRLYALKVIYGNHEDSVRLQMCREIEILRDVDNPNVVRCHDMFDHNGEIQVLLEFMDKGSLEGIHIPKESALSDLTRQVLSGLYYLHRRKIVHRDIKPSNLLINSRREVKIADFGVSRVLAQDMDPCNDSVGTIAYMSPERINTDLNHGQYDGYAGDIWSLGVSILEFYLGRFPFSVGRSGDWASLMCAICMSQPPEAPANASREFRDFIACCLQRDPARRWTAVQLLRHPFITQNSPAATTTGNMMPLPNQVHQPAHQLLPPPPHFSS

SEQ ID NO: 234 - DNA, 1245 bp, Artificial Sequence
  Description of Artificial Sequence: Synthetic polynucleotide
atggagtctcatcctcacaacaaaactgaccagacccagcatatcatcctcgtacacggtcccatcatcatcggagctggcccttctggtcttgccacttcagcatgtctctcgagccgtggagtcccttctttgatcctagaacggtcggattcaatagcatctctatggaaatctaaaacctacgaccgactcagactccatctcccaaaacacttttgccggttacccctcctggacttccctgaatattacccaaaatacccttccaaaaacgagttcttggcctaccttgagtcctacgcttcccacttccgcatcgctccaaggttcaacaagaacgtacaaaacgcagcttacgattcttcctccggtttctggagagtaaagactcatgataacacagagtacctctccaaatggcttatcgtagccaccggtgagaacgcagatccatacttccccgagattccagggagaaagaagttttccggcggaaaaatcgttcacgcgagtgagtacaaaagcggcgaagagttccggcggcagaaagttttggttgtcggatgtggaaattccggcatggaaattagcttagacctcgtccgacataacgcatctcctcatcttgttgtccggaacaccgttcatgtgttgccaagggagatacttggggtatcaacatttggagttggaatgacacttctcaaatgcttacccttaaggctcgttgacaagttcttgttattgatggccaatctttcgtttggaaataccgaccggttgggccttcgccgaccaaaaacgggtccgcttgagctgaaaaatgtcaccggcaaaagtccggttctcgatgtcggagctatgtctctcatcagatccggcatgattcagataatggaaggtgtaaaggaaataacaaagaaaggagcaaagtttatggatggtcaagaaaaggactttgactctatcatatttgccactggttacaaaagcaacgtgcctacttggcttcagggaggtgattttttcacggacgatgggatgccgaaaacgccgtttcctaacggctggagaggagggaaaggattgtacacagttggttttacgagaagaggactccttggaacggcgtctgacgccgttaagatcgctggcgaaattggtgaccagtggagagacgaaatcaaggggtccaccaggaatatgtgcagttctcgttttgtctttacctctaaatcctaa

SEQ ID NO: 235 - protein, 414 aa, Artificial Sequence
  Description of Artificial Sequence: Synthetic polypeptide
MESHPHNKTDQTQHIILVHGPIIIGAGPSGLATSACLSSRGVPSLILERSDSIASLWKSKTYDRLRLHLPKHFCRLPLLDFPEYYPKYPSKNEFLAYLESYASHFRIAPRFNKNVQNAAYDSSSGFWRVKTHDNTEYLSKWLIVATGENADPYFPEIPGRKKFSGGKIVHASEYKSGEEFRRQKVLVVGCGNSGMEISLDLVRHNASPHLVVRNTVHVLPREILGVSTFGVGMTLLKCLPLRLVDKFLLLMANLSFGNTDRLGLRRPKTGPLELKNVTGKSPVLDVGAMSLIRSGMIQIMEGVKEITKKGAKFMDGQEKDFDSIIFATGYKSNVPTWLQGGDFFTDDGMPKTPFPNGWRGGKGLYTVGFTRRGLLGTASDAVKIAGEIGDQWRDEIKGSTRNMCSSRFVFTSKS

SEQ ID NO: 236 - DNA, 1869 bp, Artificial Sequence
  Description of Artificial Sequence: Synthetic polynucleotide
atgattacggcggcggacttctaccacgttatgacggctatggttccgttatacgtagctatgatcctcgcttacggctctgtcaaatggtggaaaatcttcacaccagaccaatgctccggcataaaccgtttcgtcgctctcttcgccgttcctctcctctctttccacttcatcgccgctaacaacccttacgccatgaacctccgtttcctcgccgcagattctctccagaaagtcattgtcctctctctcctcttcctctggtgcaaactcagccgcaacggttctttagattggaccataactctcttctctctctcgacactccccaacactctagtcatggggatacctcttctcaaaggcatgtatggtaatttctccggcgacctcatggttcaaatcgttgttcttcagtgtatcatttggtacacactcatgctctttctctttgagtaccgtggagctaagcttttgatctccgagcagtttccagacacagcaggatctattgtttcgattcatgttgattccgacattatgtctttagatggaagacaacctttggaaactgaagctgagattaaagaagatgggaagcttcatgttactgttcgtcgttctaatgcttcaaggtctgatatttactcgagaaggtctcaaggcttatctgcgacacctagaccttcgaatctaaccaacgctgagatatattcgcttcagagttcaagaaacccaacgccacgtggctctagttttaatcatactgatttttactcgatgatggcttctggtggtggtcggaactctaactttggtcctggagaagctgtgtttggttctaaaggtcctactccgagaccttccaactacgaagaagacggtggtcctgctaaaccgacggctgctggaactgctgctggagctgggaggtttcattatcaatctggaggaagtggtggcggtggaggagcgcattatccggcgccgaacccagggatgttttcgcccaacactggcggtggtggaggcacggcggcgaaaggaaacgctccggtggttggtgggaaaagacaagacggaaacggaagagatcttcacatgtttgtgtggagctcaagtgcttcgccggtctcagatgtgttcggcggtggaggaggaaaccaccacgccgattactccaccgctacgaacgatcatcaaaaggacgttaagatctctgtacctcaggggaatagtaacgacaaccagtacgtggagagggaagagtttagtttcggtaacaaagacgatgatagcaaagtattggcaacggacggtgggaacaacataagcaacaaaacgacgcaggctaaggtgatgccaccaacaagtgtgatgacaagactcattctcattatggtttggaggaaacttattcgtaatcccaactcttactccagtttattcggcatcacctggtccctcatttccttcaagtggaacattgaaatgccagctcttatagcaaagtctatctccatactctcagatgcaggtctaggcatggctatgttcagtcttgggttgttcatggcgttaaacccaagaataatagcttgtggaaacagaagagcagcttttgcggcggctatgagatttgtcgttggacctgccgtcatgctcgttgcttcttatgccgttggcctccgtggcgtcctcctccatgttgccattatccaggcagctttgccgcaaggaatagtaccgtttgtgtttgccaaagagtataatgtgcatcctgacattcttagcactgcggtgatatttgggatgttgatcgcgttgcccataactcttctctactacattctcttgggtctatga

SEQ ID NO: 237 - protein, 622 aa, Artificial Sequence
  Description of Artificial Sequence: Synthetic polypeptide
MITAADFYHVMTAMVPLYVAMILAYGSVKWWKIFTPDQCSGINRFVALFAVPLLSFHFIAANNPYAMNLRFLAADSLQKVIVLSLLFLWCKLSRNGSLDWTITLFSLSTLPNTLVMGIPLLKGMYGNFSGDLMVQIVVLQCIIWYTLMLFLFEYRGAKLLISEQFPDTAGSIVSIHVDSDIMSLDGRQPLETEAEIKEDGKLHVTVRRSNASRSDIYSRRSQGLSATPRPSNLTNAEIYSLQSSRNPTPRGSSFNHTDFYSMMASGGGRNSNFGPGEAVFGSKGPTPRPSNYEEDGGPAKPTAAGTAAGAGRFHYQSGGSGGGGGAHYPAPNPGMFSPNTGGGGGTAAKGNAPVVGGKRQDGNGRDLHMFVWSSSASPVSDVFGGGGGNHHADYSTATNDHQKDVKISVPQGNSNDNQYVEREEFSFGNKDDDSKVLATDGGNNISNKTTQAKVMPPTSVMTRLILIMVWRKLIRNPNSYSSLFGITWSLISFKWNIEMPALIAKSISILSDAGLGMAMFSLGLFMALNPRIIACGNRRAAFAAAMRFVVGPAVMLVASYAVGLRGVLLHVAIIQAALPQGIVPFVFAKEYNVHPDILSTAVIFGMLIALPITLLYYILLGL

SEQ ID NO: 238 - DNA, 1176 bp, Artificial Sequence
  Description of Artificial Sequence: Synthetic polynucleotide
atggtgaaactggagaactcgaggaaacccgaaaaaatttcgaacaagaacatccccatgtccgatttcgtggtcaatctggatcatggtgatccaacggcgtacgaagaatactggaggaagatgggtgacaggtgtacggtgacgatacgtggttgtgatctcatgagttacttcagcgacatgacgaacttgtgttggttccttgagccagagcttgaagatgcgatcaaggacttgcacggtgttgttggtaacgctgcgacggaggatcggtacatagtggttgggaccggttcgacgcagctttgtcaagccgccgtccacgcactctcttcactagccaggagtcaacctgtcagcgtcgtcgccgccgctcctttttactccacatatgtggaggagacgacatatgttcggtcgggtatgtacaagtgggaaggagacgcatggggtttcgacaaaaagggtccgtacatcgagctagtgacgtcacctaataaccctgacggaaccatcagagagacggtggtgaaccgtccagacgacgacgaagccaaagtgatccatgactttgcttattactggccccactacactcccatcactcgccgtcaagaccatgacatcatgctcttcactttctccaagatcacaggccacgctgggtcccgtattgggtgggcattggtgaaggacaaggaggtagctaagaagatggttgagtatattattgtgaactcgattggtgtgtctaaggagtcacaggttcgaacagctaagatactcaacgttctaaaggagacttgtaagagcgagtccgagtctgagaatttcttcaagtatggtcgtgagatgatgaagaatcggtgggagaagctacgtgaagttgtgaaagagagcgatgctttcactcttcccaagtaccctgaagcattttgcaactactttggaaaatcactcgaatcttaccctgcgtttgcgtggctagggacgaaggaagagacggatctggtaagtgaattgaggagacacaaggtaatgagcagagctggagagcgttgtggatctgacaagaagcatgtccgagtcagcatgcttagtcgtgaagacgttttcaatgtctttctcgagagactcgccaacatgaagctcattaaaagcattgacctttag

SEQ ID NO: 239 - protein, 391 aa, Artificial Sequence
  Description of Artificial Sequence: Synthetic polypeptide
MVKLENSRKPEKISNKNIPMSDFVVNLDHGDPTAYEEYWRKMGDRCTVTIRGCDLMSYFSDMTNLCWFLEPELEDAIKDLHGVVGNAATEDRYIVVGTGSTQLCQAAVHALSSLARSQPVSVVAAAPFYSTYVEETTYVRSGMYKWEGDAWGFDKKGPYIELVTSPNNPDGTIRETVVNRPDDDEAKVIHDFAYYWPHYTPITRRQDHDIMLFTFSKITGHAGSRIGWALVKDKEVAKKMVEYIIVNSIGVSKESQVRTAKILNVLKETCKSESESENFFKYGREMMKNRWEKLREVVKESDAFTLPKYPEAFCNYFGKSLESYPAFAWLGTKEETDLVSELRRHKVMSRAGERCGSDKKHVRVSMLSREDVFNVFLERLANMKLIKSIDL

SEQ ID NO: 240 - DNA, 4107 bp, Artificial Sequence
  Description of Artificial Sequence: Synthetic polynucleotide
atgggtgagaaagcgattgacgaagacaaagtagaagcgatgaagagcagcaagacctctcttgttttcgccattaacggacaaagattcgagctcgagctctcttctattgatccttccaccacactcgtcgatttcttgcgcaacaagactcctttcaagagcgtcaagcttggttgtggcgaaggtggttgtggcgcttgtgttgttcttctttcaaagtatgatccattgctcgaaaaagtcgatgaattcacaattagctcgtgtctcacgcttctctgtagcattgatggctgttccatcactacctcagacgggctcggcaacagcagagtcggtttccatgccgtccacgagcgtatcgccggttttcatgccacacaatgcggtttctgtactcctggaatgagcgtttcgatgttttctgctctcttgaacgctgataagtctcatccacctcctcgcagcggtttctcaaatctcacggctgtagaagctgagaaggctgtgtcagggaatctttgccggtgtactggatatagaccgcttgtggatgcttgtaagagttttgcagcggatgtggatatcgaagatctcggattcaatgccttttgcaagaagggagaaaacagagatgaggttttaagaaggttgccatgttatgatcatacatcatctcatgtctgtacatttccggagttcttgaagaaggaaatcaagaacgatatgagtcttcattcaagaaagtatcgatggtcaagcccggttagtgtctcagagcttcaagggttattagaagtcgagaatggtttgtcggttaagttagttgcgggtaacacgagcaccgggtattacaaagaagaaaaagagaggaagtacgaaagatttatcgatatcaggaagattccggagtttactatggtgagaagtgatgagaaaggagttgaattaggagcttgtgtcactatatcgaaagctattgaggttctaagagaggaaaaaaatgtttctgtgttggcgaaaatcgctactcatatggagaaaattgcaaacagattcgtgaggaacacgggaacgataggtggaaacattatgatggctcagagaaaacagtttccttcggatcttgcaaccatacttgttgctgctcaagcaacggtgaagatcatgactagcagctcgagtcaagaacagttcacattggaggagtttctacaacaacctcctcttgatgcaaaatctcttcttttgagcctcgagattccatcttggcactccgcgaagaagaacggttcttcagaagatagtattttgctatttgaaacttacagagcagcgcctcgtcctctaggaaacgcattggcatttctgaatgcggctttctcagctgaagttactgaagcacttgatggcattgttgtaaatgattgccaattagtttttggagcttatgggaccaaacatgcacacagggcaaagaaagtagaagagtttcttacaggaaaagtgatatctgatgaagttttgatggaagctattagcttacttaaagatgagatagtacctgataagggtacttcgaatcccgggtatagatcaagcttggctgttacttttctcttcgagttcttcggatctttaactaaaaaaaacgctaaaacgacaaacggttggctcaatggaggatgcaaagagattggttttgatcagaatgttgaatctttgaaacctgaagctatgctgtcatctgcacaacaaatagttgaaaatcaagagcatagtccggtcgggaaaggcattacaaaggctggagcttgtctccaagcatctggtgaggctgtttatgtagacgacattcctgctccggaaaattgtctatacggcgcatttatttacagtacaatgccgctagcgcgaattaagggtataaggttcaagcaaaacagagttccagaaggagttcttggcattattacttacaaagatattcccaaaggcgggcaaaatatcggtaccaacggtttctttacctcggatcttttgttcgcagaagaagtcactcattgtgcgggtcagataatcgcctttttggttgcagatagtcaaaagcatgcagatattgcagcaaatcttgttgtgatagattacgacaccaaagatttaaaaccacctatactgtccttagaagaagctgtcgaaaactttagccttttcgaggtccctccacctctgcgtggttacccggttggtgatatcaccaagggaatggatgaagctgaacataagattcttggatcaaagataagtttcgggtcacagtacttcttctatatggagacacaaacagctcttgcagtgccggatgaagacaactgtatggtggtttatagctcgactcaaacccctgagtttgtacatcaaaccatcgctggatgtcttggagttcctgagaacaatgtgcgtgtcatcactagaagagttggaggcggattcggtgggaaagccgtgaaatcaatgcctgttgctgcagcttgtgcacttgcagcatccaaaatgcagcgtcctgtgaggacatatgtgaaccgaaaaacggatatgataactaccggaggaagacatccgatgaaagtcacatatagtgttggattcaaatccaatggaaagattactgctttagatgtagaggtgttacttgatgcagggttaaccgaagatataagcccgcttatgccgaagggaatacaaggagcactaatgaagtatgattggggtgctctgtctttcaatgtgaaagtatgcaaaacaaacactgtgagcagaaccgcgctgagagctcctggggatgtacaaggatcatatataggagaagccatcattgaaaaagtagcttcatatctttcagttgatgttgatgagatcaggaaggttaatcttcatacatatgagagcttaaggttgtttcacagtgccaaagctggtgaattttctgagtatacgttaccattgctttgggacagaatcgatgagttctcgggatttaacaagcggaggaaggtggttgaggagtttaatgcatcaaacaagtggagaaagagagggatttcacgtgtgcctgcggtttatgcagtgaacatgcgatcaacaccgggaagagtaagcgttttgggagatgggtcaatagttgtggaggttcaagggattgagataggacaagggctttggacaaaggtgaaacagatggctgcatattcccttggtttgatccagtgcggtactacaagtgatgaactgcttaaaaaaatcagggtcattcaatccgacacactaagtatggtgcaaggctcaatgactgctggtagtacaacctctgaagcgagtagtgaagcggtaaggatttgctgtgatggcttagttgaaaggcttttaccagtcaagaccgctttggtggagcaaacaggaggacctgtgacttgggatagtctcatcagtcaggcttatcagcaatcgataaacatgtccgttagtagcaaatacatgcctgactccactggcgaatacctgaactatggaattgcagcgagcgaggttgaagtaaacgttttgacgggagaaacaacgatcctgcgtacagatattatctatgattgtgggaagagtctcaatcccgctgttgatttaggacagattgaaggagcctttgttcaaggacttggtttcttcatgcttgaagagttcctaatgaactcagacggtctcgtggtaacagacagcacatggacttacaagatcccaacggttgacacaatcccaagacagtttaatgtggagattctcaacagtggacaacacaagaatcgtgttctttcatccaaagcttcgggtgaaccgccattgcttttagcggcttctgttcactgcgcggtacgagcagctgttaaagaagctaggaaacagatcctgtcatggaatagtaataaacaagggactgatatgtacttcgaattgcctgttccagcaacaatgcctattgtgaaggagttttgtggacttgatgttgtcgagaaatacttggaatggaaaatccagcaaaggaaaaatgtttga

SEQ ID NO: 241 - protein, 1368 aa, Artificial Sequence
  Description of Artificial Sequence: Synthetic polypeptide
MGEKAIDEDKVEAMKSSKTSLVFAINGQRFELELSSIDPSTTLVDFLRNKTPFKSVKLGCGEGGCGACVVLLSKYDPLLEKVDEFTISSCLTLLCSIDGCSITTSDGLGNSRVGFHAVHERIAGFHATQCGFCTPGMSVSMFSALLNADKSHPPPRSGFSNLTAVEAEKAVSGNLCRCTGYRPLVDACKSFAADVDIEDLGFNAFCKKGENRDEVLRRLPCYDHTSSHVCTFPEFLKKEIKNDMSLHSRKYRWSSPVSVSELQGLLEVENGLSVKLVAGNTSTGYYKEEKERKYERFIDIRKIPEFTMVRSDEKGVELGACVTISKAIEVLREEKNVSVLAKIATHMEKIANRFVRNTGTIGGNIMMAQRKQFPSDLATILVAAQATVKIMTSSSSQEQFTLEEFLQQPPLDAKSLLLSLEIPSWHSAKKNGSSEDSILLFETYRAAPRPLGNALAFLNAAFSAEVTEALDGIVVNDCQLVFGAYGTKHAHRAKKVEEFLTGKVISDEVLMEAISLLKDEIVPDKGTSNPGYRSSLAVTFLFEFFGSLTKKNAKTTNGWLNGGCKEIGFDQNVESLKPEAMLSSAQQIVENQEHSPVGKGITKAGACLQASGEAVYVDDIPAPENCLYGAFIYSTMPLARIKGIRFKQNRVPEGVLGIITYKDIPKGGQNIGTNGFFTSDLLFAEEVTHCAGQIIAFLVADSQKHADIAANLVVIDYDTKDLKPPILSLEEAVENFSLFEVPPPLRGYPVGDITKGMDEAEHKILGSKISFGSQYFFYMETQTALAVPDEDNCMVVYSSTQTPEFVHQTIAGCLGVPENNVRVITRRVGGGFGGKAVKSMPVAAACALAASKMQRPVRTYVNRKTDMITTGGRHPMKVTYSVGFKSNGKITALDVEVLLDAGLTEDISPLMPKGIQGALMKYDWGALSFNVKVCKTNTVSRTALRAPGDVQGSYIGEAIIEKVASYLSVDVDEIRKVNLHTYESLRLFHSAKAGEFSEYTLPLLWDRIDEFSGFNKRRKVVEEFNASNKWRKRGISRVPAVYAVNMRSTPGRVSVLGDGSIVVEVQGIEIGQGLWTKVKQMAAYSLGLIQCGTTSDELLKKIRVIQSDTLSMVQGSMTAGSTTSEASSEAVRICCDGLVERLLPVKTALVEQTGGPVTWDSLISQAYQQSINMSVSSKYMPDSTGEYLNYGIAASEVEVNVLTGETTILRTDIIYDCGKSLNPAVDLGQIEGAFVQGLGFFMLEEFLMNSDGLVVTDSTWTYKIPTVDTIPRQFNVEILNSGQHKNRVLSSKASGEPPLLLAASVHCAVRAAVKEARKQILSWNSNKQGTDMYFELPVPATMPIVKEFCGLDVVEKYLEWKIQQRKNV

SEQ ID NO: 242 - DNA, 1278 bp, Artificial Sequence
  Description of Artificial Sequence: Synthetic polynucleotide
atggcgaccaataatgattttggagctttcattgagaaagttacaatctctccaacttctacttcctcgtcgcctccttctctacagggtcttactttcgccattaaagacatttttgatgtggaaggacgcgttaccggttttggtaacccggattggttaaggacacactcggcagctacttctacagctccagtagtttcatctctcttagaagctggtgccacagctttgggtattaccattatggatgaaatggcttacagtataaacggagaaaatgcgcattatgggactccgagaaacccgattgctttcgatagagtgcctgggggatcatcgagtggctcagccgtagctgtagctgctcgtcttgtggatttttctattggaactgataccggagggagtgtacgagttccagcatcttactgtgggattttcggtttccggccatcccacggtgcagtttccactgtcggacttactccaatggctcagagcttcgacacagttggatggtttgctcgggacacagccactttgaaacgtgtaggttgcgttctcctgcagcagcatcacttgaaccccatcgaaccatctcaactgattatcgcggatgactgcttcaagctgtgtagtgtaccgcatgatctcttggtgcagcctctggttggatccgtggaaaaatcgtttggaggcaacactgtagtaaagaaggtgaatcttggagagtacattggacagaatgttccaagccttaaacatttcatgacaagtgacgatgtcactacacaacaagagttctgcattccgtctctcatggccctatcgagttcaatgagattgttacaaagacatgaattcaagataaaccacggtgcatggatctcgtcggtgaagccagagtttggtcctggaatatcagaacgaattgaggaagctatcagaacatccgacgagaagatcgaccattgccggtccgtgaaatctgaactgataacggctctttcaactttgctcggggagaagggtgtgttggtgattccaacggtaccaggtcctccaccgcatctccaagctaatgtggctgcacttgaatctttccgcagcagagccttcagcttgttgtcgatcgcaggcgtttctggattctgtcaggtgagcataccattggggctacacgaaaatcttccggtttcggtatcattggtagctaagtatggctcagacggttttcttctgagtcttgtggattcccttgctgcatttatttga

SEQ ID NO: 243 - protein, 425 aa, Artificial Sequence
  Description of Artificial Sequence: Synthetic polypeptide
MATNNDFGAFIEKVTISPTSTSSSPPSLQGLTFAIKDIFDVEGRVTGFGNPDWLRTHSAATSTAPVVSSLLEAGATALGITIMDEMAYSINGENAHYGTPRNPIAFDRVPGGSSSGSAVAVAARLVDFSIGTDTGGSVRVPASYCGIFGFRPSHGAVSTVGLTPMAQSFDTVGWFARDTATLKRVGCVLLQQHHLNPIEPSQLIIADDCFKLCSVPHDLLVQPLVGSVEKSFGGNTVVKKVNLGEYIGQNVPSLKHFMTSDDVTTQQEFCIPSLMALSSSMRLLQRHEFKINHGAWISSVKPEFGPGISERIEEAIRTSDEKIDHCRSVKSELITALSTLLGEKGVLVIPTVPGPPPHLQANVAALESFRSRAFSLLSIAGVSGFCQVSIPLGLHENLPVSVSLVAKYGSDGFLLSLVDSLAAFI

SEQ ID NO: 244 - DNA, 1248 bp, Artificial Sequence
  Description of Artificial Sequence: Synthetic polynucleotide
atgggttcttgtaaagaagaagaaaaaactgatcaacaaccaaaatggttatgggttaatggacctataatagtaggtgctggaccttctggtttagcagtttcagcttctcttaaagaaaatggagtcccttcacttattcttgaaagaagtgattgtattgcttctttatggcaacaaaaaacctatgatcgtttaaaacttcatctccctaaacagttttgtcaactcccattatttggttttcctgaaaatttccctaaatacccttcaaaaaaacagttcatttcttacttagaggattatgctaaacactttggtataattcccaagtttaaacagtctgtaaaagttgcagaatttgatcatgttagtggattttggaaggtggaaactcaagattttttgtatctttcaaagtggttgattgtggctacaggggaaaatgcagagccagttataccagaaattcaagggattggtaagtttaaaggaacagtaatgcatactagtctttataagtctggtactgagtttaataatcaaagggttttggtaattggctgtggaaattctggtatggaagttagcttggacctttgtagacataatgccatccctcacatggtcgtcagaaattccgtgcatattttaccaagggaaatgttagggatatcaacattttcaatagcaatggcacttctcaaatggttgcctataagagttgttgacaagttgctattactagtagccaatttgaccttaggtagcacagataagttaggtctccggcgaccaaaaaccggtccacttgaactgaaaaatgccaccggaaaaactccggtactcgacgttggtgcattgtcacaaataagaaatggaaaaattcagattatgcacggtgtgaaggagataactaaaataggagcaaagtctatagatggaaaagaaggagaatttgattcaataatcctagcaactggatacaaaagcaatgttccttcttggcttaagggaactgacttcttcacagaacaagggatgccaaaaacaccatttcctaatggctggaaaggggaaaatggattatacacggtggggtttacaagaagagggcttttagggactgcaaatgatgcaaaaaacattgccagggatattagtgatcaatggaggaaatacaagggcttctgcaaaaatttttgtacttcaagaaatctatcagatagccagggtatatgtttttag

SEQ ID NO: 245 - protein, 415 aa, Artificial Sequence
  Description of Artificial Sequence: Synthetic polypeptide
MGSCKEEEKTDQQPKWLWVNGPIIVGAGPSGLAVSASLKENGVPSLILERSDCIASLWQQKTYDRLKLHLPKQFCQLPLFGFPENFPKYPSKKQFISYLEDYAKHFGIIPKFKQSVKVAEFDHVSGFWKVETQDFLYLSKWLIVATGENAEPVIPEIQGIGKFKGTVMHTSLYKSGTEFNNQRVLVIGCGNSGMEVSLDLCRHNAIPHMVVRNSVHILPREMLGISTFSIAMALLKWLPIRVVDKLLLLVANLTLGSTDKLGLRRPKTGPLELKNATGKTPVLDVGALSQIRNGKIQIMHGVKEITKIGAKSIDGKEGEFDSIILATGYKSNVPSWLKGTDFFTEQGMPKTPFPNGWKGENGLYTVGFTRRGLLGTANDAKNIARDISDQWRKYKGFCKNFCTSRNLSDSQGICF

SEQ ID NO: 246 - DNA, 1167 bp, Artificial Sequence
  Description of Artificial Sequence: Synthetic polynucleotide
atgggttcttataaagaagaagaaaaaaccgatcaacaaccaaaatggttatgggttaatggacctataatagtaggtgctggaccttctggtttagcagtttcagcttgtcttaaagaaaatggagtcccttcacttattcttgaaagaagtgattgtattgcttctttatggcaacaaaaaacttatgatcgtttaaaacttcatctccctaaacagttttgtcaactcccattatttggttttcctgaaaattttcctaaatacccttcaaaaaaactgttcatttcttacttagaggattatgctaaacactttggtatagttcctaagtttaaacagtctgttaaagttgcagaatttgatcatgttagtggattttggaaggtagaaactcaagattttttgtatctttcaaaatggttgattgtggctacaggagaaaatgcagagccagtaataccagaaattcaagggattgataagtttaaaggagcggtgttgcatactagtgtttataagtcaggtactgagtttaataatcaaagggttttggtaattggttgtggaaattctggtatggaagttagcttggacctttgtagacataatgccatccctcacatggtcgtcagaaattctgtgcatattttaccaagggaaatgttagggatatcaacattttcaatagcaatggcacttctcaaatggttgcctataagagtagttgacaagttgctgttactagtagcaaatttgaccttaggtagcacagataagttaggtctccggcgaccaaaaaccggtccacttgaactgaaaaatgccacggaaaaactcgtctcgacgttgattatgcacggtgtgaaggagataactaaaataggagcaaagtttatagatggaaaagaaggagaatatgattcaataatcttagcaactggatacaaaagcaatgttccttcttggcttaagggaactgacttcttcacagaacaagggatgccaaagacaccatttccaaatggttggaaaggggaaaatggattatacacagtggggtttacaagaagagggcttttagggactgcaaatgatgcaaaaaaaattgccagggacataagtgatcaatggaggaaatacaagggcttctgcaaaaacttttga

SEQ ID NO: 247 - protein, 388 aa, Artificial Sequence
  Description of Artificial Sequence: Synthetic polypeptide
MGSYKEEEKTDQQPKWLWVNGPIIVGAGPSGLAVSACLKENGVPSLILERSDCIASLWQQKTYDRLKLHLPKQFCQLPLFGFPENFPKYPSKKLFISYLEDYAKHFGIVPKFKQSVKVAEFDHVSGFWKVETQDFLYLSKWLIVATGENAEPVIPEIQGIDKFKGAVLHTSVYKSGTEFNNQRVLVIGCGNSGMEVSLDLCRHNAIPHMVVRNSVHILPREMLGISTFSIAMALLKWLPIRVVDKLLLLVANLTLGSTDKLGLRRPKTGPLELKNATEKLVSTLIMHGVKEITKIGAKFIDGKEGEYDSIILATGYKSNVPSWLKGTDFFTEQGMPKTPFPNGWKGENGLYTVGFTRRGLLGTANDAKKIARDISDQWRKYKGFCKNF

SEQ ID NO: 248 - DNA, 1833 bp, Artificial Sequence
  Description of Artificial Sequence: Synthetic polynucleotide
atgataactttatctgatttctaccatgttatgactgctgttgtgccactttatgtggctatgatattagcttatggttctgttaaatggtggaagattttttcacctgaccagtgttctggtattaacagatttgttgcacttttcgcagttccacttctctctttccactttatagctgctaataatccttacactatgaacatacggttcattgctgctgacactcttcagaaacttattgttcttggagctcttgctatttgggctaattttagcaaaaggggtagtttagaatggagtataacactcttttctttatcaactcttccaaatactttagttatgggtattcctttgttaaaaggaatgtatggtgatttttcagggagtttaatggttcaaatagttgtactacagtgtattatttggtacactttgatgctttttatgtttgagttcagaggtgcaaggatgctgatctctgagcaatttcctgatactgctggctcaattgtctcaatccatgttgattctgatgtcatgtcattagatggtagacaagttttggaaactgaagctgaagtgaaagaagatggaaaacttcatgttactgtgagaaaatcaaatgcctcaaggtctgatatattttcaagaaggtcgcagggattttcttctacaactccaagaccatcaaatttaacaaatgcagagatttactctctacaatcttcaagaaatccaactccaagagggtcaagttttaaccatactgatttttactcaatggttgctggtgggagaaactcaaactttggtgcaaatgatgtttatgggatgtcagcttcaagaggaccaactcctagaccttcaaattatgaggaagaaagtggaaaatcaagatttaattacaaccatggagctgcagcacaacaaagtaatactaataataatactactcattatccagctccaaatcctggtatgttttcacctagtaatggtgcaaaagcagtgggttctaacactaataacaagaaaggtaacaaaggagaggaaggtggtaaagatcttcatatgtttgtttggagttcaagtgcttctcctgtttctgatgtatttggtggtcatgattatggagctaatttagaccagaatacagctaaggatgtaagagtacctatctctcctggaaaagttgaggtgcaaagaaacaatcaagaaaactacatggagagagatgactttagctttgcaaatagagatgcagaaatgaatattcacaaccaagaaggtgaaaaaggtggagaaaataaagcaaaggttatgccaccaacaagtgtaatgactaggcttatactaattatggtttggaggaaacttattagaaatccaaacacttattcaagcttgtttggtctcacttggtctctagtttcattcaggtggaatttgaagatgcctgctataattgcacagtccatatctatattgtcagatgcaggacttggcatggcaatgttcagtctaggtctgtttatggctttgcaaccaaggataatagcatgtgggaattctacagcagcttttgctatggctgtgagattccttacaggtccagctgtcatggcagctgcttccattgctgttggccttcgtggagttctcttacacgtagccattgtacaggcagctctaccccaaggaattgtcccctttgtcttcgccaaggaatacaacgttcaccctgacattcttagcacgggtgtcatttttgggatgttgattgccttgccgattacactggtctactacattttgatgggactttaa

SEQ ID NO: 249 - protein, 610 aa, Artificial Sequence
  Description of Artificial Sequence: Synthetic polypeptide
MITLSDFYHVMTAVVPLYVAMILAYGSVKWWKIFSPDQCSGINRFVALFAVPLLSFHFIAANNPYTMNIRFIAADTLQKLIVLGALAIWANFSKRGSLEWSITLFSLSTLPNTLVMGIPLLKGMYGDFSGSLMVQIVVLQCIIWYTLMLFMFEFRGARMLISEQFPDTAGSIVSIHVDSDVMSLDGRQVLETEAEVKEDGKLHVTVRKSNASRSDIFSRRSQGFSSTTPRPSNLTNAEIYSLQSSRNPTPRGSSFNHTDFYSMVAGGRNSNFGANDVYGMSASRGPTPRPSNYEEESGKSRFNYNHGAAAQQSNTNNNTTHYPAPNPGMFSPSNGAKAVGSNTNNKKGNKGEEGGKDLHMFVWSSSASPVSDVFGGHDYGANLDQNTAKDVRVPISPGKVEVQRNNQENYMERDDFSFANRDAEMNIHNQEGEKGGENKAKVMPPTSVMTRLILIMVWRKLIRNPNTYSSLFGLTWSLVSFRWNLKMPAIIAQSISILSDAGLGMAMFSLGLFMALQPRIIACGNSTAAFAMAVRFLTGPAVMAAASIAVGLRGVLLHVAIVQAALPQGIVPFVFAKEYNVHPDILSTGVIFGMLIALPITLVYYILMGL

SEQ ID NO: 250 - DNA, 1191 bp, Artificial Sequence
  Description of Artificial Sequence: Synthetic polynucleotide
atgtgtggcacagaggcttgtcttatcaagtgttctccagtcccttgtgtgactcctgaaacaagagaaaatggcactctcatcaagtgggatactcttatcaatcttgatcatggtgatccagtaatgtatgaatcatactggcgaaagatgggaaacaggtgtgacattacattcagtggttatcagtcattgagttattttgctaacgccaagaacttgtgctggttccttgagccaaaactagaagaagagatcaagaggctgcacaatgtggttggaaatgcaattgtggatgatcattatatcgtcgttgggacaggatcaagccagcttatacaggctgcactctatgctctttctcctacagatgaacctgaaccaatcagtgtagtttcagctgcacctttctattcgtcatatccagaagtgactgattttgtgcgttcagggctgtacaaatgggcaggagatgcaagaaattttgagaaagatggaccatatattgagttcattacatctccaaataacccagatggggttactcgagagcctgtagttaatggaattcaagggatattaattcatgatttagcttattactggccacagtacactgctattacctctcctgccaaatatgatgttatgctctttacagtttccaaatgcactggccatgctggatccagaattggttgggctcttgttagggacaaagaggtggctaggaagatgacaaaattcatggaaattagcacaataggggtatcaaaggaagctcaattgagagctgcaaagattcttggactgatttctgatagctgtttagatcccacattggaaaacttctttgagtatagtcaatctcacatgactaaaagatggcagaggttaagagaagttgttaagagcagtgaccttttcactctccagaaatatccacttcagtattgccacttcacaagagacttctatgaatcacaccctgcttttgcatggctaatgtgcaaaggaagtgaagatgaccttgagaagcttcttaaaggatacaagattcaaacaaggagtggaagaaaatttgggagtgatccaaaatgtgttaggataagtatgctgagtagggatgaagacttcaacatttttttgcagaggcttatgtctattcaaggagttacaaatggaaattaa

SEQ ID NO: 251 - protein, 396 aa, Artificial Sequence
  Description of Artificial Sequence: Synthetic polypeptide
MCGTEACLIKCSPVPCVTPETRENGTLIKWDTLINLDHGDPVMYESYWRKMGNRCDITFSGYQSLSYFANAKNLCWFLEPKLEEEIKRLHNVVGNAIVDDHYIVVGTGSSQLIQAALYALSPTDEPEPISVVSAAPFYSSYPEVTDFVRSGLYKWAGDARNFEKDGPYIEFITSPNNPDGVTREPVVNGIQGILIHDLAYYWPQYTAITSPAKYDVMLFTVSKCTGHAGSRIGWALVRDKEVARKMTKFMEISTIGVSKEAQLRAAKILGLISDSCLDPTLENFFEYSQSHMTKRWQRLREVVKSSDLFTLQKYPLQYCHFTRDFYESHPAFAWLMCKGSEDDLEKLLKGYKIQTRSGRKFGSDPKCVRISMLSRDEDFNIFLQRLMSIQGVTNGN

SEQ ID NO: 252 - DNA, 4062 bp, Artificial Sequence
  Description of Artificial Sequence: Synthetic polynucleotide
atggaacagaaaaaagggaatttagtttttgcagtaaatggagagaggtttgagttgccaaatattgacccctctactactttacttcagttcttgcgttctgagacttgtttcaagagtcctaaacttggttgtggtgaaggtggttgtggggcttgtgttgttctggtctcaaagtatgatcctaagcttaaaaaggtcgaagattttagcgcgagttcatgccttacacttctttgtagtttaaatggttactcaattactacaagtgaaggccttgggaacaccagagatggttttcactctattcatgaaagatttgctggtttccatgcttctcaatgtggcttttgcactcctggaatgtgtatgtcatttttctcagctcttgtcaatgccgataaaggaaacaagccggatcctccaccaggattttctaagcttacttcatctgaagctgaaaaggccatagcagggaacctctgtcggtgcactggataccggcctattgctgatgcctgcaagacttttgctgctgatattgatatagaggatttggggttcaattctttttggaaaaagggagattccaaggaattgaaaataagtaaattacctccttatgatccaaccaagaattttagtacatatccggagttcttgaaaagtgaatgcgccacaaatttggactccacaaggtacccttggtacagtcctacttccattgaagagctgcagagcttgttgaactccagtgtggcggataatggtgcgagctttaaactggtcgttggtaatacaggcacaggttattataaggaaactcagcgatatgatcattacgttgatctcaggtatattcctgaactctcaatcatcaaaagagatcagacaggcattgaagtgggagcaactgtgactatctctaaacttatagcattcttgaaagaggaaaacaaagtcaatttgggtccatatgggaagctggtgtccgaaaagctggttaaccacatggagaagattgcttcaccatttgttaggaactctgctagtgtgggaggaaatttggttatggcacaaaagaatggttttccttcagatattgctacattatttcttggtgtgggtgctaccgttagcttgatgaccggtcatggacttgaaaaactcacatgggaggaattattatcgagaccgccaatagactcaaggaccgtgcttctaagtgtttggatcccatttaaagaagagagttctctcaaaacctttactaagtttttgtttgagacctatcgagctgctccccgacctcatgggaatgcaatagcatatgtaaacgctgcttttggggttgatgtttctctctgccagaacggcatcctgataaacgatatccggctggcgtttggtgcttatggtacaaaacatgcaacaagggctaaaatggtagaggaatatctaacagggaaaatattaaatgcacatgttttaagtgaagcacttaaattagtcaaactagctgtggtaccggaagatgggactttacacccagagtatagatcaagcttggccgtcagttatgtttttcagtttctttatcccttagttgatgttcattctgctattgtcaatggaatcaatgacatctcactcgaggaagtttcaaaaagtagtaatgatagtcaggggagaaaacaaacactactgtcttcttctaagcaggttgtggaatcaagtagcgagcactatccagtgggtgaaccaatgaagaaggttggagctgccatgcaagctgctggtgaagctgtttatgtagatgacattccgtcaccaccaaactgcctgcacggagcatttatctacagcacaaaaccattagcaggtgtaaaaggaatccatcttgagtctaattcattaacagatggattcaccgacattattactttcaaggatatcccaagtggagggtcaaatgtaggatctattacaatgtttggtcctgagcctttattcgcagacgatctcgcccgatgtgctggcgacagaattgcagttgcggttgctgacactcagaggtctgctgatgtggctgccacaacagcccttgttgaatatgacactgtaaatgtaaattcaccgattttaactgtcgaggaagctgttgagaaatctagctttttccaaatcccgccatttctatatccaaaacaggttggcgatttctcaaaaggaatggctgaagctgatcacaagattctctctgctgaggtaagacttggttccgagtactatttttatatggagacacagactgcccttgcaattccagatgaagacaactgtatggttgtttatacttcaagccagtgccctgagtatgcgcaaaatgtgattgccagttgtcttggtgttcctgaacacaatatccgtgttattacaagaagggttggaggtggctttgggggcaaggcagtcagagcaatgcctgtttcgacagcctgtgcacttgcagcatacaagttaaggcggcctgtgaggataaatgtcaaccggaacagcgacatgataatgacaggaggaagacacccaatgaaagtaacatacagtgtaggattcaagtcaagcggaaagatcacagcattacatcttgatatattgataaatgctgggatttcggaagatataagccccctcctaccatcaaatgtgattaaagcattaaagaaatatgattggggtgccttatcttttgatgtaaaagtatgcaagacgaatcttaccagcaaatcagctatgcgggcccctggggaggtgcaaggatcttatattgccgaagctataatggagcatgtagcgagtttactgtcaaaggaggtggattctgtcagaaataataatgttcatacattggaaagcattaatttattctatgataacatcgtaactgaagtaggagaatatacgttgcctagtatcatggataagttggccgtgtcctcgagctttttccaacgtagcaagatggtggaacagtttaaccagaaaaacacatggaagaaaaagggtatttctcgactgccaataatgtttgaagctatgcaacgaccgaccccaggaaaagtcagtatcctgtcggatggatcaattgttgtagaggttggagggattgaaatcggccaagggctatggacaaaggttagacagatgactgcatatgctcttggtttaattgaaagtagttggagtgaagaacttgtagggaaagtacgagtcatacaagcagacagcttaagcttagtgcaaggtgggtatacggctggaagcactacatcggaatcaagctgtgaagcagttagacgttgctgtagtgtcttggttgaaagactgactcctctgaagaaacagttgcaggaacaaaatggctctcttgattggccaacgctcattcgccaggcacaaatgcaagcagtaaacttagcagcaaattcttattatgtaccagaatccagttccatgagttatttgaactttggtgccgctgtcagtgaggtggatatagatattcttactggagagactgccattttgcagtcggatattatttacgactgtgggcagagcttgaatccagctgtcgatatgggacagattgaaggagcttatgtacaaggaattggattttttatgcatgaagaatatcttacaaacgacgatgggttgatggtctcaaatagcacttggacatacaagatcccaacaatcgacaccataccccagaatttcaacgttcatttggtaaacagtggacatcacgaaaaacgtgttctctcttccaaagcatctggtgaaccgccactgctacttgcagcttcagtccattgtgcaacaagagcggctgttaaagcagcaagagaacaactcaaagtttggggcaagctcgacgagtctgcttcagaattctatctggatgttcctgccatattacctgttgtgaagacgcagtgtggtctagattatgtggagaaatacttagaaagtttactgactcagaaatctaactaa

SEQ ID NO: 253 - protein, 1353 aa, Artificial Sequence
  Description of Artificial Sequence: Synthetic polypeptide
MEQKKGNLVFAVNGERFELPNIDPSTTLLQFLRSETCFKSPKLGCGEGGCGACVVLVSKYDPKLKKVEDFSASSCLTLLCSLNGYSITTSEGLGNTRDGFHSIHERFAGFHASQCGFCTPGMCMSFFSALVNADKGNKPDPPPGFSKLTSSEAEKAIAGNLCRCTGYRPIADACKTFAADIDIEDLGFNSFWKKGDSKELKISKLPPYDPTKNFSTYPEFLKSECATNLDSTRYPWYSPTSIEELQSLLNSSVADNGASFKLVVGNTGTGYYKETQRYDHYVDLRYIPELSIIKRDQTGIEVGATVTISKLIAFLKEENKVNLGPYGKLVSEKLVNHMEKIASPFVRNSASVGGNLVMAQKNGFPSDIATLFLGVGATVSLMTGHGLEKLTWEELLSRPPIDSRTVLLSVWIPFKEESSLKTFTKFLFETYRAAPRPHGNAIAYVNAAFGVDVSLCQNGILINDIRLAFGAYGTKHATRAKMVEEYLTGKILNAHVLSEALKLVKLAVVPEDGTLHPEYRSSLAVSYVFQFLYPLVDVHSAIVNGINDISLEEVSKSSNDSQGRKQTLLSSSKQVVESSSEHYPVGEPMKKVGAAMQAAGEAVYVDDIPSPPNCLHGAFIYSTKPLAGVKGIHLESNSLTDGFTDIITFKDIPSGGSNVGSITMFGPEPLFADDLARCAGDRIAVAVADTQRSADVAATTALVEYDTVNVNSPILTVEEAVEKSSFFQIPPFLYPKQVGDFSKGMAEADHKILSAEVRLGSEYYFYMETQTALAIPDEDNCMVVYTSSQCPEYAQNVIASCLGVPEHNIRVITRRVGGGFGGKAVRAMPVSTACALAAYKLRRPVRINVNRNSDMIMTGGRHPMKVTYSVGFKSSGKITALHLDILINAGISEDISPLLPSNVIKALKKYDWGALSFDVKVCKTNLTSKSAMRAPGEVQGSYIAEAIMEHVASLLSKEVDSVRNNNVHTLESINLFYDNIVTEVGEYTLPSIMDKLAVSSSFFQRSKMVEQFNQKNTWKKKGISRLPIMFEAMQRPTPGKVSILSDGSIVVEVGGIEIGQGLWTKVRQMTAYALGLIESSWSEELVGKVRVIQADSLSLVQGGYTAGSTTSESSCEAVRRCCSVLVERLTPLKKQLQEQNGSLDWPTLIRQAQMQAVNLAANSYYVPESSSMSYLNFGAAVSEVDIDILTGETAILQSDIIYDCGQSLNPAVDMGQIEGAYVQGIGFFMHEEYLTNDDGLMVSNSTWTYKIPTIDTIPQNFNVHLVNSGHHEKRVLSSKASGEPPLLLAASVHCATRAAVKAAREQLKVWGKLDESASEFYLDVPAILPVVKTQCGLDYVEKYLESLLTQKSN

SEQ ID NO: 254 - DNA, 1278 bp, Artificial Sequence
  Description of Artificial Sequence: Synthetic polynucleotide
atggagacatgtgaatatggagctctcattgagaaattcacactgcaaccaatttgctcttcttcagagcaagtccccttgaatggcttaacctttgccgtgaaagacatatttgatgtggaaggacatatcactggttttggaaatccagactgggccaagacccattctgcggcaacatctactgcaacaactgtgctcactcttttgaaggctggtgctacttgtattggtaaaactgtcatggatgaaatggcttacagcataaatggtgaaaatgttcattatggcacgcctttgaatcctgtttcaccagatcgggtacctggagggtcttcaagtggatctgcagttgcagtcggtgcaaagcttgtagatttctccttagggactgacactggaggaagtgttagagttcctgcatcatattgtggaatttatggtattcgaccttctcatggagttgtttcaactgccggagtcacacctatggcacaaagctttgatacagtggggtggtttgcaagggatcctctgatcttaaagcaagttggaagagtcctacttcaatctccccaaatgaaatccgtgcgtccaactaacagtatcattgcagaagactgttttaagctcctggattccaagagtaaccaattgattgaagtacttgttaactcagtggagaagctatatggaagtcatatgattaaatacgtgagtgtaggggattatattgagggaaatgttccaagtttgaagaaattcatgacgcttggaactggcaatgatgaatcttacattccatccttgctagctctctcagctgccatgcggttgcttcaaaggtatgaattcaaggagaatcatggagaatgggttagtacagtcaaacctagtttaggtccgggaatagcagaacgcgtatgggaagcgctgaaggccacagatgaaaatattgatgtgtgccactctgtgaaggctgagcttcgagcagctctcactgctctccttggggattctggtatacttgcaatcccaactgttcctggacctccaccaaaactaagaagcgagacaagtgcattggaaggatttcgtgttaaggcttttagtctgttatcaattgctggagtatctggattttgccaggtcagcatacctctggggatgcaagacaatcttcctatatcagtttctttactggtaaaacatggttcagactggttgctgcttgatgctgttgaagctattcacaaagttctcaaggggcaaatctga

SEQ ID NO: 255 - protein, 425 aa, Artificial Sequence
  Description of Artificial Sequence: Synthetic polypeptide
METCEYGALIEKFTLQPICSSSEQVPLNGLTFAVKDIFDVEGHITGFGNPDWAKTHSAATSTATTVLTLLKAGATCIGKTVMDEMAYSINGENVHYGTPLNPVSPDRVPGGSSSGSAVAVGAKLVDFSLGTDTGGSVRVPASYCGIYGIRPSHGVVSTAGVTPMAQSFDTVGWFARDPLILKQVGRVLLQSPQMKSVRPTNSIIAEDCFKLLDSKSNQLIEVLVNSVEKLYGSHMIKYVSVGDYIEGNVPSLKKFMTLGTGNDESYIPSLLALSAAMRLLQRYEFKENHGEWVSTVKPSLGPGIAERVWEALKATDENIDVCHSVKAELRAALTALLGDSGILAIPTVPGPPPKLRSETSALEGFRVKAFSLLSIAGVSGFCQVSIPLGMQDNLPISVSLLVKHGSDWLLLDAVEAIHKVLKGQI

SEQ ID NO: 256 - protein, 6 aa, Artificial Sequence
  Description of Artificial Sequence: Synthetic 6xHis tag
HHHHHH

SEQ ID NO: 257 - DNA, 2400 bp, Artificial Sequence
  Description of Artificial Sequence: Synthetic polynucleotide
ttagcacttaaaaaacataggtttacatgctctcattgtcacgccaggccgctaattaaatggtacatttcatcatccccattttttggcctcatagttaattatcacaatttctgaaagcaacatcagaacaaccccacatttcttgtggtcctataattactgctagatagtccaaacccatctgcctatttagggcttgtgaatgaggattgaaaatggtagagaatatttgcaaaggcatcatgcatatatggaaaagactaaagagagagttagtgccttgcaaagcggattctcacagttgtagaaaaggactcaccattttcaagaatactcccggcatgaagatggacaatttaatataaaaaacaaagaaaatagtaattaagtgcgttgagatgaatgaaatttatccgctcttaattgaatatggggaattgaaagaaatttctgataataaattaatgagtcttacatgacgtggatccgacttaatctagtctatttaaactaagaatagataagaatagagaatatagacaaaagagaggctcattggctagggtttcaagggagttccttgaacataagtggcaagtacaagcacaaagccaatttccatggactaaagatgaataagatgtgtcgtgtggtatggtgggaaggtgaggaggtatggggtaattggagatgctaaacctctctaaaagctcttttgctccaaatatctaaatccatctctatcacttttggcgactgccccaaaatttgcaacttatgaattaaagttttaatatttttaagttaataaattctgaattaataatttaacatattcaataaactttttaaaacaaattacgtatataccatcaaactggctgcaccatgatcactttctaaactcacaatgacatatggatttaatcaggcacaaagtcatgttgatagaaagagatagtacggagaatgaagaaaaaggtaggggagagagatggggtgagtggggaaaagatagggttctctttttagtgaaagcgacagggtctgagaaccctaggtcaaaagttgcataaacctctatacaggcttcttcactcccttactactaatatactctcattaaggcttgaggtttaattcattaaaattgtggtttaattattgtatcccctcaaacgaaataattgtccttgtcgaggttagacaatgttgcgtactattttcaaacgcagtcagccattattctcctatcctttacagtcgagattcaaagacagaaagtagcatgcaagctgttattaatttactttgattaggactttgccaagaaaatgaagaaccttttcttttttcttttaatttagttatcttacaacatgtaatttttcctagcaagcaaatacggtaacttttttttttattctcatttaatttgttggagctattgctactttgatgacttcaaccaaatcctggttggtaggcggagggtgctgacgatggaaactacccctcttgtccaaatacgataacctaaaaaatagaataatagcttattgtactgtgctgcaaaaattgcattgtcagtatacataattaaaatctattttgaatgtgtggagggcaaagaggggtgactggtctagggttgtagaaatcaggtgggagagagaatggtatttgtctctgtgtcagctgatatcacgtgaagaggcacaataagaagtccttcgtatccattcacttcccaaaaataccggcattactacaaatatagtactagcacttgctttctctatccccatctttgctatttcctttccctttccaactttttggctttagaattgcaaagatggagggaattgtggttctttgtatctgtaaaatttttcctccaagctccagttgtagctagcttaatgcgtggacgcgcgcgcgcacacactagaaatctgcaatctatatatatattcacaaggcactcacatatcaaaaaccacatagacattgtatagagagagctgtcgttctcaagcagaaaaaatgatatgatttcatcagcatgtggtcaaccaaatagttcaattctagtctttgcttcctctttctaattactgtataaatagagccacaaggacatagaattgagaaaataaaagacaataaaaacaaatctagctacttaagcgaatgatgatgactctctctcagtagtcttaactcttaatacccttgttttccttcttgtgctgcagtttgattggttaattaacctaatcaaaagatgttttaactgtgttttatccgtctttctcaagatctatcttagtcccaccacatagctccctcaagctacagctgcaaaatatatactatatatatatataacaa

SEQ ID NO: 258 - DNA, 6 bp, Artificial Sequence
  Description of Artificial Sequence: Synthetic oligonucleotide
cacgtg

SEQ ID NO: 259 - DNA, 6 bp, Artificial Sequence
  Description of Artificial Sequence: Synthetic oligonucleotide
ttatcc

SEQ ID NO: 260 - DNA, 8 bp, Artificial Sequence
  Description of Artificial Sequence: Synthetic oligonucleotide
aaacccta

The invention claimed is:

1. A nucleic acid molecule comprising a promoter active in axillary bud tissue, but not active in a tobacco seed, wherein said promoter:
   (a) comprises SEQ ID NO: 257; and
   (c) is operably linked to a heterologous nucleic acid molecule.

2. The nucleic acid molecule of claim 1, wherein said heterologous nucleic acid molecule encodes at least one axillary bud-degrading product.

3. The nucleic acid molecule of claim 2, wherein said at least one axillary bud-degrading product is selected from the group consisting of a microRNA, a small interfering RNA, and a polypeptide.

4. The nucleic acid molecule of claim 3, wherein said polypeptide comprises an amino acid sequence at least 70% identical or similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

5. The nucleic acid molecule of claim 3, wherein said small RNA molecule comprises at least 18 contiguous nucleotides identical or complementary to a polynucleotide selected from the group consisting of SEQ ID NOs: 83-101.

6. A tobacco plant comprising a nucleic acid molecule comprising a promoter, wherein said promoter:
   (a) comprises SEQ ID NO: 257; and
   (b) is operably linked to a heterologous nucleic acid molecule,
wherein said tobacco plant comprises no suckers or reduced suckers after topping as compared to a control tobacco plant of the same variety when grown under comparable conditions, wherein said control tobacco plant lacks said promoter operably linked to said heterologous nucleic acid molecule.

7. The tobacco plant of claim 6, wherein said promoter is active in axillary meristem tissue at least 7 days after said topping.

8. The tobacco plant of claim 6, wherein said promoter is not active in:
   (a) a seedling tobacco plant;
   (b) shoot apical meristem tissue; or
   (c) both (a) and (b).

9. The tobacco plant of claim 6, wherein said reduced suckers comprises reduced dry biomass of the suckers, reduced fresh weight of the suckers, reduced length of the suckers, reduced diameter of the suckers, reduced number of total suckers, or any combination thereof.

10. The tobacco plant of claim 6, wherein said tobacco plant is selected from the group consisting of a flue-cured variety tobacco plant, a bright variety tobacco plant, a Burley variety tobacco plant, a Virginia variety tobacco plant, a Maryland variety tobacco plant, a Galpão variety tobacco plant, a dark variety tobacco plant, an Oriental variety tobacco plant, and a Turkish variety tobacco plant.

11. The tobacco plant of claim 6, wherein said heterologous nucleic acid molecule encodes at least one axillary bud-degrading product.

12. The tobacco plant of claim 11, wherein said at least one axillary bud-degrading product is selected from the group consisting of a microRNA, a small interfering RNA, and a polypeptide.

13. The tobacco plant of claim 12, wherein said polypeptide comprises an amino acid sequence at least 70% identical or similar to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

14. The tobacco plant of claim 12, wherein said small RNA molecule comprises at least 18 contiguous nucleotides identical or complementary to a polynucleotide selected from the group consisting of SEQ ID NOs: 83-101.

15. A tobacco product comprising cured tobacco material from the tobacco plant of claim 6, wherein the cured tobacco material comprises the nucleic acid molecule comprising said promoter operably linked to a heterologous nucleic acid.

16. The tobacco product of claim 15, wherein said tobacco product is selected from the group consisting of a cigarette, a kretek, a bidi cigarette, a cigar, a cigarillo, a non-ventilated cigarette, a vented recess filter cigarette, pipe tobacco, snuff, chewing tobacco, moist smokeless tobacco, fine cut chewing tobacco, long cut chewing tobacco, and pouched chewing tobacco product.

17. The tobacco product of claim 15, wherein said cured tobacco material is selected from the group consisting of air-cured tobacco material, fire-cured tobacco material, sun-cured tobacco material, and flue-cured tobacco material.

* * * * *